United States Patent
Neumann et al.

(10) Patent No.: US 12,215,361 B2
(45) Date of Patent: Feb. 4, 2025

(54) COMPOSITIONS AND METHODS FOR MAKING EPIGENETIC MODIFICATIONS

(71) Applicant: Whitehead Institute for Biomedical Research, Cambridge, MA (US)

(72) Inventors: Edwin Neumann, Somerville, MA (US); Tessa Bertozzi, Cambridge, MA (US); Jonathan Weissman, Cambridge, MA (US)

(73) Assignee: WHITEHEAD INSTITUTE FOR BIOMEDICAL RESEARCH, Cambridge, MA (US)

( * ) Notice: Subject to any disclaimer, the term of this patent is extended or adjusted under 35 U.S.C. 154(b) by 0 days.

(21) Appl. No.: 18/444,590

(22) Filed: Feb. 16, 2024

(65) Prior Publication Data
US 2024/0279623 A1   Aug. 22, 2024

Related U.S. Application Data

(60) Provisional application No. 63/520,594, filed on Aug. 18, 2023, provisional application No. 63/485,860, filed on Feb. 17, 2023.

(51) Int. Cl.
*C12N 9/10* (2006.01)
*A61K 38/46* (2006.01)
*C12N 9/22* (2006.01)
*C12N 15/86* (2006.01)

(52) U.S. Cl.
CPC .......... *C12N 9/1007* (2013.01); *A61K 38/465* (2013.01); *C12N 9/22* (2013.01); *C12N 15/86* (2013.01); *C12Y 201/01037* (2013.01); *C07K 2319/80* (2013.01); *C12N 2750/14143* (2013.01)

(58) Field of Classification Search
CPC ........ C12N 9/1007; C12N 9/22; C12N 15/86; C12N 2750/14143; A61K 38/465; C12Y 201/01037; C07K 2319/80
See application file for complete search history.

(56) References Cited

U.S. PATENT DOCUMENTS

| | | | |
|---|---|---|---|
| 7,534,775 B2 | 5/2009 | Zhang et al. | |
| 11,254,933 B2 | 2/2022 | Gilbert et al. | |
| 11,434,491 B2 | 9/2022 | Chen et al. | |
| 2019/0300868 A1 | 10/2019 | Gilbert et al. | |
| 2021/0139918 A1 | 5/2021 | Chen et al. | |
| 2021/0322577 A1* | 10/2021 | Lande | A61K 47/549 |
| 2022/0259593 A1 | 8/2022 | Weissman et al. | |
| 2023/0002459 A1 | 1/2023 | Zeitler et al. | |
| 2023/0042624 A1 | 2/2023 | Gilbert et al. | |
| 2023/0103909 A1 | 4/2023 | Chen et al. | |
| 2023/0124253 A1 | 4/2023 | Chen et al. | |
| 2023/0212323 A1 | 7/2023 | Gilbert et al. | |

FOREIGN PATENT DOCUMENTS

| | | | |
|---|---|---|---|
| WO | 2016/011080 A2 | 1/2016 | |
| WO | 2016/063264 A1 | 4/2016 | |
| WO | WO-2018053035 A1 * | 3/2018 | .............. A61P 35/00 |
| WO | 2018/112423 A1 | 6/2018 | |
| WO | 2019/204766 A1 | 10/2019 | |
| WO | 2021/021677 A1 | 2/2021 | |
| WO | 2021/247570 A2 | 12/2021 | |
| WO | 2021/248023 A3 | 1/2022 | |
| WO | 2022/140577 A2 | 6/2022 | |
| WO | 2024/102942 A1 | 5/2024 | |
| WO | 2024/102947 A1 | 5/2024 | |

OTHER PUBLICATIONS

Alerasool et al. (2020, Nature Methods, Date Published: Nov. 2020, https://doi.org/10.1038/s41592-020-0966-x, examiner cited) {herein Akerasool} (Year: 2020).*
Paschon, D.E. et al., "Diversifying the structure of zinc finger nucleases for high-precision genome editing," Nature Communications, vol. 10; 1133; 13 pages (2019).
Prusiner, S.B., "Prions," Proc. Natl. Acad. Sci., vol. 95; 13363-13383 (1998).
Ran, F.A. et al., "In vivo genome editing using *Staphylococcus aureus* Cas9," Nature, vol. 520; 186-191 (2015).
Raymond, G.J. et al., "Antisense oligonucleotides extend survival of prion-infected mice," JCI Insight, vol. 4; No. 16; e131175; 14 pages (2019).
Reidenbach et al., Multimodal small-molecule screening for human prion protein binders, J Biol Chem., 13516-31, 295(39) (2020).
Ren, D. et al., "Immune Responses to Gene Editing by Viral and Non-Viral Delivery Vectors Used in Retinal Gene Therapy," Pharmaceutics, vol. 14; 21 pages (2022).
Richt, J.A. et al., "Production of cattle lacking prion protein," Nature Biotechnology, vol. 25; No. 1; 132-138 (2007).
Robinson, J.T. et al., "Integrative genomics viewer," Nature Biotechnology, vol. 29; No. 1; 24-26 (2011).
Rothbauer, U. et al., "Targeting and tracing antigens in live cells with fluorescent nanobodies," Nature Methods, vol. 3; No. 11; 887-889 (2006).

(Continued)

*Primary Examiner* — Paul J Holland
*Assistant Examiner* — Erica Nicole Jones-Foster
(74) *Attorney, Agent, or Firm* — Hamilton, Brook, Smith & Reynolds, P.C.

(57) ABSTRACT

The disclosure provides, in various embodiments, fusion proteins comprising a DNA-binding domain, a DNMT3A-binding domain, and a H3K4me0; and polynucleotides and vectors encoding one or more of the fusion proteins. The disclosure also provides, in various embodiments, gene-delivery systems, cells, compositions (e.g., pharmaceutical compositions) and kits comprising one or more of the fusion proteins polynucleotides, or vectors; methods of epigenetically modifying a genomic locus in a cell; and methods of treating a subject (e.g., a human) in need thereof.

30 Claims, 48 Drawing Sheets
(43 of 48 Drawing Sheet(s) Filed in Color)
Specification includes a Sequence Listing.

(56) References Cited

OTHER PUBLICATIONS

Saito et al., Fanzor is a eukaryotic programmable RNA-guided endonuclease, Nature, 660-68, 620(7974) (2023).
Samaranch et al., AAV9-mediated expression of a non-self protein in nonhuman primate central nervous system triggers widespread neuroinflammation driven by antigen-presenting cell transduction, Mol Ther., 329-337, 22(2) (2014).
Sander, J.D. et al., "Selection-free zinc-finger-nuclease engineering by context-dependent assembly (CoDA)," Nature Methods, vol. 8; No. 1; 67-69 (2011).
Santos, R. et al., "A comprehensive map of molecular drug targets," Nature Reviews, vol. 16; 19-34 (2017).
Saudou, F. and Humbert, S., "The Biology of Huntingtin," Neuron, vol. 89; 19 pages (2016).
Schindelin et al., Fiji: an open-source platform for biological-image analysis, Nat Methods. 9(7):676-82 (2012).
Shah & Muir, Split Inteins: Nature's Protein Ligases, Isr J Chem., 854-61, 51(8-9) (2011).
Silva et al., Meganucleases and other tools for targeted genome engineering: perspectives and challenges for gene therapy, Curr Gene Ther., 11-27, 11(1) (2011).
Simpson et al., Detecting DNA cytosine methylation using nanopore sequencing, Nature Methods, 407-10, 14(4) (2017).
Skedsmo, F.S. et al., "Demyelinating polyneuropathy in goats lacking prion protein," The FASEB Journal, vol. 34; 2359-2375 (2020).
Smits, A.H. et al., "Biological plasticity rescues target activity in CRISPR knock outs," Nature Methods, vol. 16; 1087-1093 (2019).
Stevens, A.J. et al., "Design of a Split Intein with Exceptional Protein Splicing Activity," J. Am. Chem. Soc., vol. 138; 2162-2165 (2016).
Subramanian, M. et al., "RNAi-mediated rheostat for dynamic control of AAV-delivered transgenes," Nature Communications, vol. 14; 1970; 12 Pages (2023).
Suetake, I. et al., "DNMT3L Stimulates the DNA Methylation Activity of Dnmt3a and Dnmt3b through a Direct Interaction," The Journal of Biological Chemistry, vol. 279; No. 26; 27816-27823 (2004).
Tanenhaus, A. et al., "Cell-Selective Adeno-Associated Virus-Mediated SCN1A Gene Regulation Therapy Rescues Mortality and Seizure Phenotypes in a Dravet Syndrome Mouse Model and Is Well Tolerated in Nonhuman Primates," Human Gene Therapy, vol. 33; No. 11-12; 579-597 (2022).
Thakore et al., Editing the epigenome: technologies for programmable transcription and epigenetic modulation, Nat Methods, 127-137, 13(2) (2016).
Urrutia, KRAB-containing zinc-finger repressor proteins, Genome Biol., 231 (2003), 4(10).
Vallabh, S.M. et al., "Towards a treatment for genetic prion disease: trials and biomarkers," Lancet Neurol, vol. 19; 361-368 (2020).
Van, M. V. et al., "Nanobody-mediated control of gene expression and epigenetic memory," Nature Communications, vol. 12; 537; 12 Pages (2021).
Veland et al., DNMT3L facilitates DNA methylation partly by maintaining DNMT3A stability in mouse embryonic stem cells, Nucleic Acids Res., 152-67, 47(1) (2019).
Wagner et al., High prevalence of Streptococcus pyogenes Cas9-reactive T cells within the adult human population, Nat Med., 242-48, 25(2) (2019).
Wegmann et al., Persistent repression of tau in the brain using engineered zinc finger protein transcription factors, Mar. 19, 2021, Science Advances, 1-19, 7(12): eabe1611.
Wilson & Gilbert, The Promise and Challenge of In Vivo Delivery for Genome Therapeutics, Oct. 11, 2017, ACS Chem Biol., 376-82, 13(2).
Xu, T. et al., "Structure of nucleosome-bound DNA methyltransferases DNMT3A and DNMT3B," Nature, vol. 586; 151-155 (2020).
Yan et al., Cytosine base editors induce off-target mutations and adverse phenotypic effects in transgenic mice, Mar. 30, 2023, Nat Commun., 1-12, 14(1): 1784.
Zeitler et al., Allele-selective transcriptional repression of mutant HTT for the treatment of Huntington's disease, Nature Medicine, 1131-42, 25(7) (2019).
Zhang et al., Chromatin methylation activity of Dnmt3a and Dnmt3a/3L is guided by interaction of the ADD domain with the histone H3 tail, Mar. 11, 2010, Nucleic Acids Res., 4246-53, 38(13).
Zhang et al., Deciphering TAL effectors for 5-methylcytosine and 5-hydroxymethylcytosine recognition, Nature Communications 8(1): 1-9 (2017).
Zhang et al., Efficient precise knockin with a double cut HDR donor after CRISPR/Cas9-mediated double-stranded DNA cleavage, Genome Biology, 1-18, 18 (2017).
Zolotukhin & Vandenberghe, AAV capsid design: A Goldilocks challenge, Trends Mol Med., 183-93, 28(3) (2022).
Zuo et al., Cytosine base editor generates substantial off-target single-nucleotide variants in mouse embryos, Apr. 19, 2019, Science, 289-92, 364(6437).
Ahuja et al., Epigenetic Therapeutics: A New Weapon in the War Against Cancer, Annu Rev Med., 73-89, 67 (2016).
Alerasool et al., An efficient KRAB domain for CRISPRi applications in human cells, Nat Methods, 1093-96, 17(11) (2020).
Altschul et al., Basic local alignment search tool, J Mol Biol. 215(3):403-10 (1990).
Amabile et al., Inheritable Silencing of Endogenous Genes by Hit-and-Run Targeted Epigenetic Editing, Cell, 219-32, 167(1) (2016).
Bankhead et al., QuPath: Open source software for digital pathology image analysis, Sci Rep., 1-7, 7(1):16878 (2017).
Banskota et al., Engineered virus-like particles for efficient in vivo delivery of therapeutic proteins, Cell, 250-65, 185(2) (2022).
Bashor et al., Complex signal processing in synthetic gene circuits using cooperative regulatory assemblies, Science, 593-597, 364 (2019).
Battaglia et al., Long-range phasing of dynamic, tissue-specific and allele-specific regulatory elements, Nature Genetics, 1504-13, 54(10) (2022).
Beerli et al., Engineering polydactyl zinc-finger transcription factors, Nat Biotechnol, 135-141, 20 (2002).
Benestad et al., Healthy goats naturally devoid of prion protein, Vet Res., 1-4, 43(1):87 (2012).
Bhakta et al., The generation of zinc finger proteins by modular assembly, Methods in Molecular Biology (Clifton, N.J.), 3-30, 649 (2010).
Bragdon et al., Cooperative assembly confers regulatory specificity and long-term genetic circuit stability, Cell, 3810-3825, 186(18) (2023).
Brandner, S. et al., "Normal host prion protein necessary for scrapie-induced neurotoxicity," Nature, vol. 379; 339-343 (1996).
Bremer et al., Axonal prion protein is required for peripheral myelin maintenance, Nat Neurosci., 310-318, 13(3) (2010).
Büeler et al., Mice Devoid of PrP Are Resistant to Scrapie, Cell, 1339-47, 73(7) (1993).
Büeler et al., Normal development and behaviour of mice lacking the neuronal cell-surface PrP protein, Nature, 577-82, 356(6370) (1992).
Byun et al., Gene Therapy for Huntington's Disease: The Final Strategy for a Cure?, J Mov Disord., 15-20, 15(1) (2022).
Cabrera et al., The sound of silence: Transgene silencing in mammalian cell engineering, Cell Syst., 950-73, 13(12) (2022).
Cai et al., Targeted genome editing by lentiviral protein transduction of zinc-finger and TAL-effector nucleases, Elife, 3:e01911 (2014).
Cappelluti et al., Durable and efficient gene silencing in vivo by hit-and-run epigenome editing, Nature, 416-423, 627 (2024).
Challis et al., Systemic AAV vectors for widespread and targeted gene delivery in rodents, Nature Protocols, 379-414, 14(2) (2019).
Chan et al., Engineered AAVs for efficient noninvasive gene delivery to the central and peripheral nervous systems, Nat Neurosci., 1172-79, 20(8) (2017).
Charlesworth et al., Identification of preexisting adaptive immunity to Cas9 proteins in humans, Nat Med., 249-54, 25(2) (2019).
Chen et al., Fusion protein linkers: property, design and functionality, Adv Drug Deliv Rev., 1357-69, 65(10) (2013).

(56) References Cited

OTHER PUBLICATIONS

Choi et al., Optimization of AAV expression cassettes to improve packaging capacity and transgene expression in neurons, Mol Brain, 1-10, 7:17 (2014).
Choi et al., Third-generation in situ hybridization chain reaction: multiplexed, quantitative, sensitive, versatile, robust, Development 145(12):dev165753 (2018).
Dantas et al., Efficacy of anti-amyloid-ß monoclonal antibody therapy in early Alzheimer's disease: a systematic review and meta-analysis, Neurol Sci. (2023).
Davis et al., Efficient in vivo base editing via single adeno-associated viruses with size-optimized genomes encoding compact adenine base editors, Nat. Biomed. Eng, 1272-1283, 6 (2022).
Doench et al., Optimized sgRNA design to maximize activity and minimize off-target effects of CRISPR-Cas9, Nature Biotechnology 34(2):184-91 (2015).
Ecco et al., KRAB zinc finger proteins, Development, 2719-29, 144(15) (2017).
Fang et al., Chimerization Enables Gene Synthesis and Lentiviral Delivery of Customizable TALE-Based Effectors, International Journal of Molecular Sciences, 1-12, 21(3):795 (2020).
Fang et al., Chimerization Enables Gene Synthesis and Lentiviral Delivery of Customizable TALE-Based Effectors, Supplementary Figures, International Journal of Molecular Sciences, 795, vol. 21, No. 3 (2020).
Fiumara et al., Genotoxic effects of base and prime editing in human hematopoietic stem cells, Nat Biotechnol. (2023).
Frost & Diamond, Prion-like mechanisms in neurodegenerative diseases, Nat Rev Neurosci., 155-9, 11(3) (2010).
Gaj et al., Targeted gene knockout by direct delivery of zinc-finger nuclease proteins, Nat Methods., 805-7, 9(8) (2012).
Gaj et al., ZFN, TALEN, and CRISPR/Cas-based methods for genome engineering, Trends Biotechnol., 397-405, 31(7) (2013).
Gilbert et al., CRISPR-mediated modular RNA-guided regulation of transcription in eukaryotes, Cell, 442-51, 154(2) (2013).
Goell et al., CRISPR/Cas-Based Epigenome Editing: Advances, Applications, and Clinical Utility, Trends Biotechnol., Trends Biotechnol., 39(7) (2021).
Greenberg et al., The diverse roles of DNA methylation in mammalian development and disease, Nat Rev Mol Cell Biol., 590-607, 20(10) (2019).
Grünewald et al., Transcriptome-wide off-target RNA editing induced by CRISPR-guided DNA base editors, Nature, 433-37, 569(7756) (2019).
Grzenda et al., Functional characterization of EZH2ß reveals the increased complexity of EZH2 isoforms involved in the regulation of mammalian gene expression, Epigenetics Chromatin, 1-20, 6(1):3 (2013).
Guo et al., Structural insight into autoinhibition and histone H3-induced activation of DNMT3A, Nature, 640-44, 517(7536) (2014).
Hamilton et al., In vivo human T cell engineering with enveloped delivery vehicles, Jan. 11, 2024, Nat Biotechnol. doi: 10.1038/s41587-023-02085-z. Epub ahead of print. PMID: 38212493.
Hino et al., An AsCas12f-based compact genome-editing tool derived by deep mutational scanning and structural analysis, Cell, 4920-35, 186(22) (2023).
Hofacker et al., Engineering of Effector Domains for Targeted DNA Methylation with Reduced Off-Target Effects, Jan. 13, 2020, Int J Mol Sci., 1-16, 21(2):502.
Holtzman et al., Editing the Epigenome: Reshaping the Genomic Landscape, Annu Rev Genomics Hum Genet., 43-71, 19 (2018).
Huang et al., An AAV capsid reprogrammed to bind human Transferrin Receptor mediates brain-wide gene delivery, Dec. 20, 2023, bioRxiv.
Huang et al., C-to-G editing generates double-strand breaks causing deletion, transversion and translocation, Nat Cell Biol., 294-304, 26(2) (2024).
Huang et al., DNA epigenome editing using CRISPR-Cas SunTag-directed DNMT3A, Genome Biol., 1-11, 18(1):176 (2017).

Hwang et al., Detailed mechanisms for unintended large DNA deletions with CRISPR, base editors, and prime editors, Jan. 5, 2024, BioRxiv.
Ibraheim et al., Self-inactivating, all-in-one AAV vectors for precision Cas9 genome editing via homology-directed repair in vivo, Nat Commun., 1-17, 12(1):6267 (2021).
Ichikawa et al., A universal deep-learning model for zinc finger design enables transcription factor reprogramming, Nat Biotechnol., 1117-29, 41(8) (2023).
International Search Report and Written Opinion received for PCT Patent Application No. PCT/US2024/016308, mailed on May 22, 2024, 9 pages.
Jia et al., Structure of Dnmt3a bound to Dnmt3L suggests a model for de novo DNA methylation, Nature, 248-51, 449(7159) (2007).
Jin, S. et al., "Cytosine, but not adenine, base editors induce genome-wide off-target mutations in rice," Science, vol. 364; 292-295 (2019).
Kaluscha et al., Evidence that direct inhibition of transcription factor binding is the prevailing mode of gene and repeat repression by DNA methylation, Nat Genet., 1895-1906, 54(12) (2022).
Katoh et al., MAFFT multiple sequence alignment software version 7: improvements in performance and usability, Mol Biol Evol. 30(4):772-80 (2013).
Khalil et al., A synthetic biology framework for programming eukaryotic transcription functions, Cell, 647-58, 150(3) (2012).
Khirallah et al., Clinical progress in genome-editing technology and in vivo delivery techniques, Trends Genet., 208-16, 39(3) (2023).
Kluesner et al., CRISPR-Cas9 cytidine and adenosine base editing of splice-sites mediates highly-efficient disruption of proteins in primary and immortalized cells, Nat Commun, 1-12, 2437 (2021).
Koblan et al., Improving cytidine and adenine base editors by expression optimization and ancestral reconstruction, Nature Biotechnology, 843-46, 36:9 (2018).
Küffer et al., The prion protein is an agonistic ligand of the G protein-coupled receptor Adgrg6, Nature, 464-68, 536(7617) (2016).
Kumaki et al., QUMA: quantification tool for methylation analysis, Nucleic Acids Res. 36(Web Server issue):W170-5 (2008).
Kungulovski et al., Epigenome Editing: State of the Art, Concepts, and Perspectives, Trends Genet., 101-113, 32(2) (2016).
Kuzmin et al., The clinical landscape for AAV gene therapies, Nat Rev Drug Discov., 173-74, 20(3) (2021).
Labun et al., CHOPCHOP v3: expanding the CRISPR web toolbox beyond genome editing, Nucleic Acids Res. 47(W1):W171-W174 (2019).
Lakkaraju et al., Glial activation in prion diseases is selectively triggered by neuronal PrPSc, Feb. 17, 2022, Brain Pathology, 1-15, 32(5).
Leibowitz et al., Chromothripsis as an on-target consequence of CRISPR-Cas9 genome editing, Nat Genet., 895-905, 53(6) (2021).
Letunic et al., Interactive Tree Of Life (iTOL) v5: an online tool for phylogenetic tree display and annotation, Nucleic Acids Res. 49(W1):W293-W296 (2021).
Levy et al., Cytosine and adenine base editing of the brain, liver, retina, heart and skeletal muscle of mice via adeno-associated viruses, Nat Biomed Eng., 97-110, 4(1) (2020).
Li et al., A Self-Deleting AAV-CRISPR System for In Vivo Genome Editing, Mol Ther Methods Clin Dev., 111-22, 12 (2018).
Li et al., Histone tails regulate DNA methylation by allosterically activating de novo methyltransferase, Cell Res., 1172-81, 21(8) (2011).
Li et al., Multidimensional control of therapeutic human cell function with synthetic gene circuits, Science, 1227-34, 378(6625) (2022).
Liao et al., featureCounts: an efficient general purpose program for assigning sequence reads to genomic features, Bioinformatics 30(7):923-30 (2014).
Ling et al., AAV-based in vivo gene therapy for neurological disorders, Nat Rev Drug Discov., 789-806, 22(10) (2023).
Liu et al., Editing DNA Methylation in the Mammalian Genome, Cell, 233-247, 167 (2016).
Love et al., Moderated estimation of fold change and dispersion for RNA-seq data with DESeq2, Genome Biol. 15(12):550 (2014).

(56) References Cited

OTHER PUBLICATIONS

Lue et al., Base editor scanning charts the DNMT3A activity landscape, Nat Chem Bio, 176-186, 19 (2022).

Lupo et al., KRAB-Zinc Finger Proteins: A Repressor Family Displaying Multiple Biological Functions, Curr Genomics, 268-78 (2013), 14(4).

Ma et al., Tuning methylation-dependent silencing dynamics by synthetic modulation of CpG density, Jun. 1, 2023, bioRxiv [Preprint], May 30, 2023.

Maddox et al., Prion disease incidence in the United States: 2003-2015, Neurology, e153-e157, 94(2) (2020).

Maeder et al., Rapid "open-source" engineering of customized zinc-finger nucleases for highly efficient gene modification, Mol Cell., 294-301, 31(2) (2008).

Mallucci et al., Depleting Neuronal PrP in Prion Infection Prevents Disease and Reverses Spongiosis, Science, 871-74, 302(5646) (2003).

McDonald et al., Reprogrammable CRISPR/Cas9-based system for inducing site-specific DNA methylation, Jun. 15, 2016, Biol Open, 866-874, 5 (6).

Miller et al., Improved specificity of TALE-based genome editing using an expanded RVD repertoire, Nature Methods 12(5):465-71 (2015).

Minikel et al., Evaluating drug targets through human loss-of-function genetic variation, Nature, 459-64, 581(7809) (2020).

Minikel et al., Prion protein lowering is a disease-modifying therapy across prion disease stages, strains and endpoints, Nucleic Acids Res., 10615-31, 48(19) (2020).

Minikel et al., Quantifying prion disease penetrance using large population control cohorts, Sci Transl Med., 1-12, 8(322):322ra9 (2016).

Mlambo et al., Designer epigenome modifiers enable robust and sustained gene silencing in clinically relevant human cells, Nucleic Acids Research, 4456-68, 46(9) (2018).

Moreno et al., Long-lasting analgesia via targeted in situ repression of NaV1.7 in mice, Science Translational Medicine, 1-14, 13(584):eaay9056 (2021).

Mortberg et al., Regional variability and genotypic and pharmacodynamic effects on PrP concentration in the CNS, JCI Insight, e156532, 7(6) (2022).

Nakamura, M et al., "CRISPR technologies for precise epigenome editing," Nature Cell Biology, vol. 23; 11-22 (2021).

Neugebauer et al., Evolution of an adenine base editor into a small, efficient cytosine base editor with low off-target activity, Nat Biotechnol., 673-85, 41(5) (2023).

Neumann, E.N et al., "Brainwide silencing of prion protein by AAV-mediated delivery of an engineered compact epigenetic editor," Science, vol. 384; 1421; 17 Pages (2024).

Nguyen et al., IQ-TREE: a fast and effective stochastic algorithm for estimating maximum-likelihood phylogenies, Mol Biol Evol. 32(1):268-74 (2015).

Nuñez et al., Genome-wide programmable transcriptional memory by CRISPR-based epigenome editing, Cell, 2503-19, 184(9) (2021).

O'Green, H. et al., "dCas9-based epigenome editing suggests acquisition of histone methylation is not sufficient for target gene repression," Nucleic Acids Research, vol. 45; No. 17; 9901-9916 (2017).

Otani et al., Structural basis for recognition of H3K4 methylation status by the DNA melhyltransferase 3A ATRX-DNMT3-DNMT3L domain., EMBO reports, Oct. 16, 2009, vol. 10, No. 11, pp. 1235-1241.

Pabo, C.O. et al., "Design and Selection of Novel CYS2HIS2 Zinc Finger Proteins," Annu. Rev. Biochem., vol. 70; 313-340 (2001).

Park, M. et al., "The epigenome: the next substrate for engineering," Genome Biology, vol. 17; 183; 17 pages (2016).

\* cited by examiner

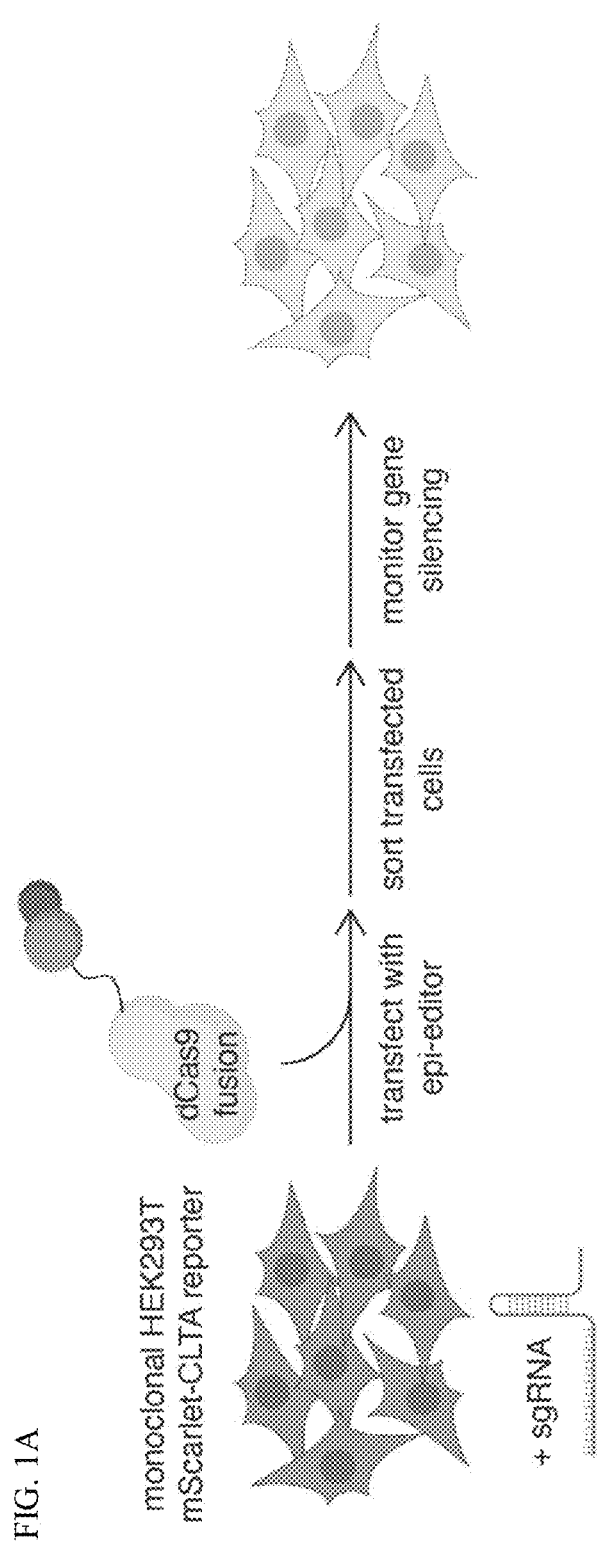
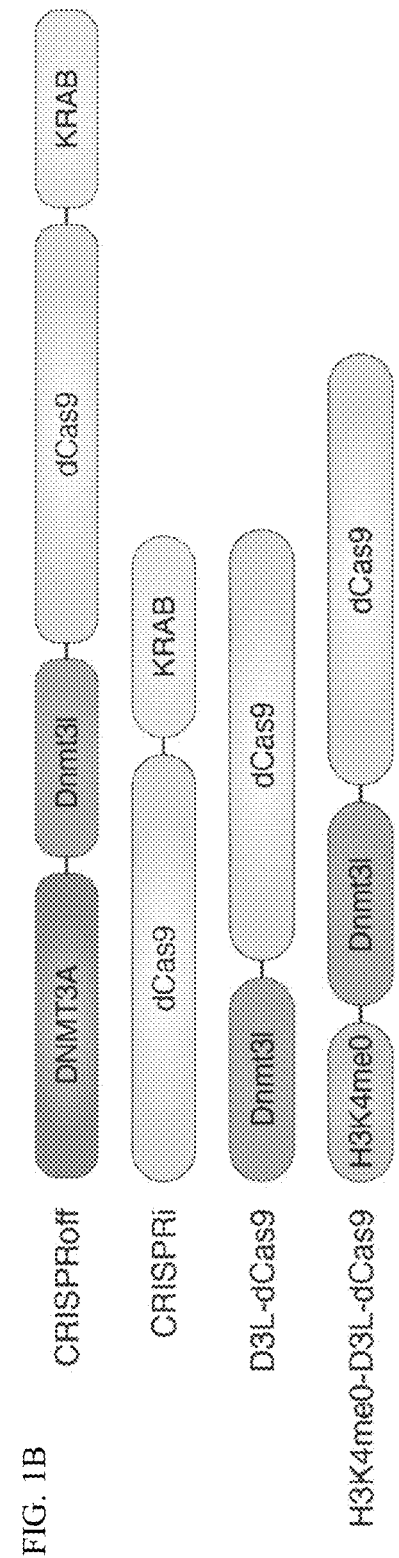
FIG. 1A
FIG. 1B

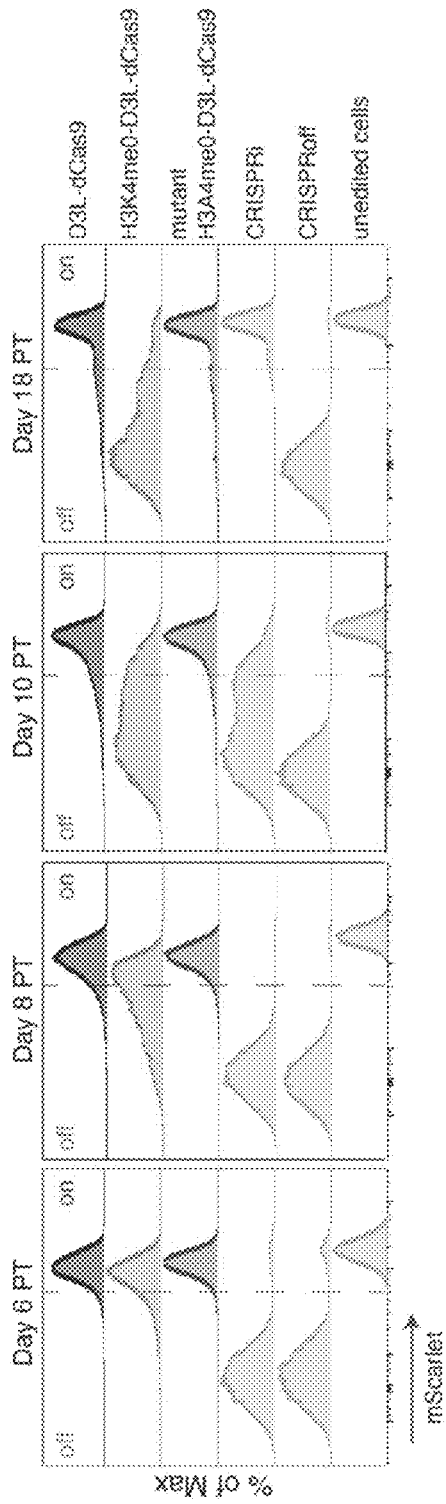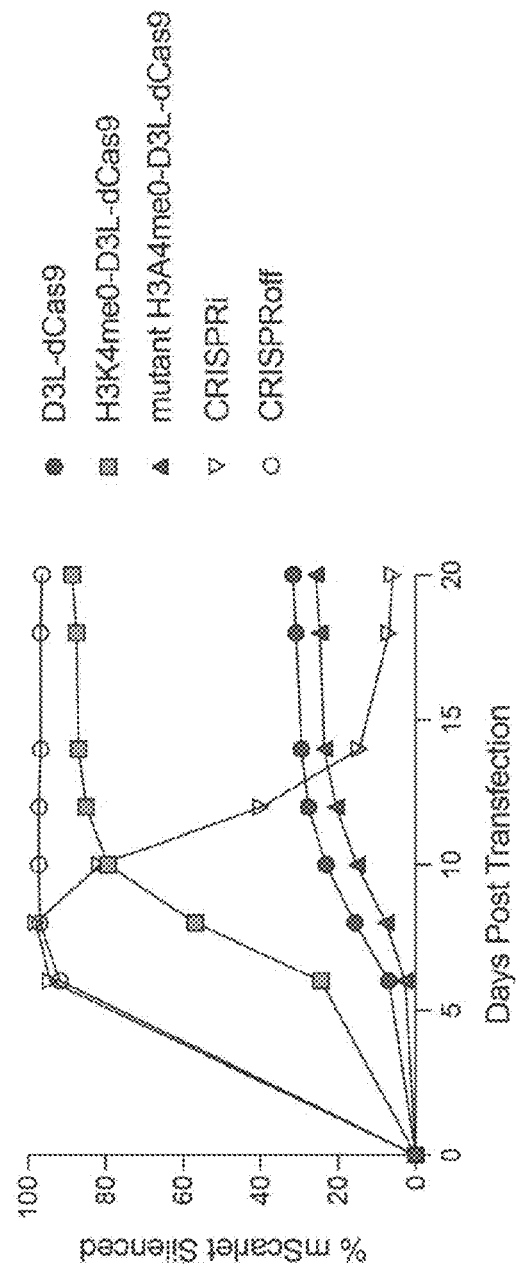
FIG. 2A
FIG. 2B

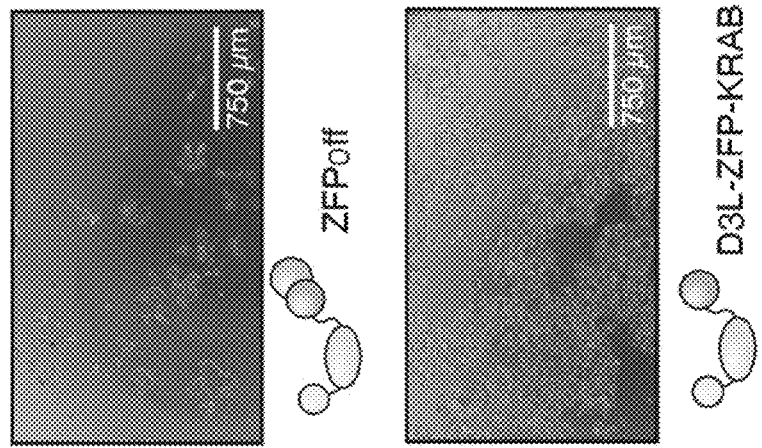
FIG. 15F
FIG. 15G
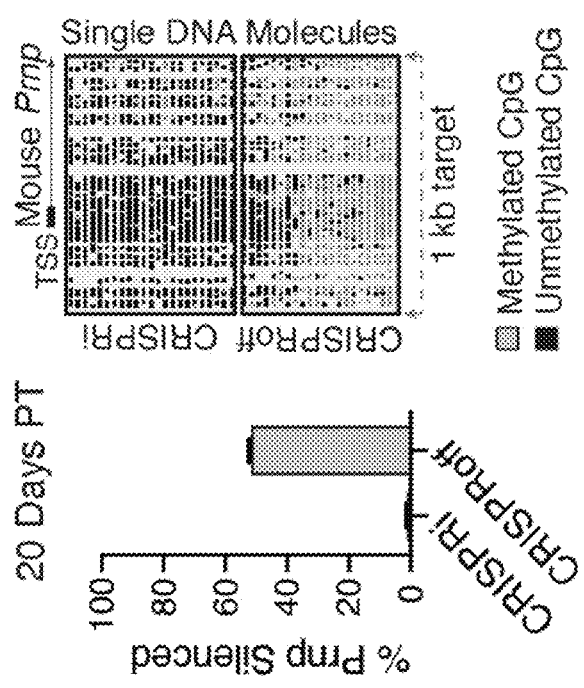
FIG. 15D
FIG. 15E
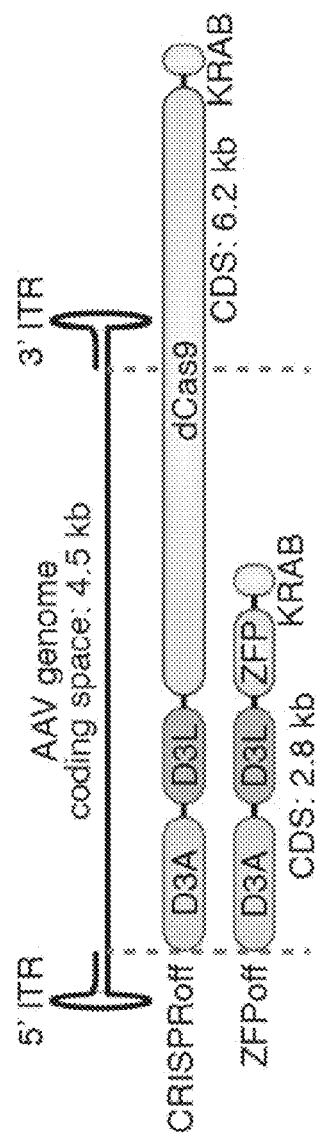

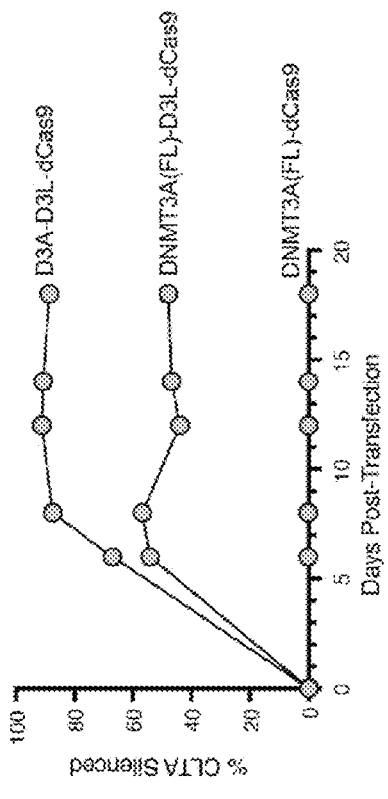
FIG. 17A
FIG. 17B
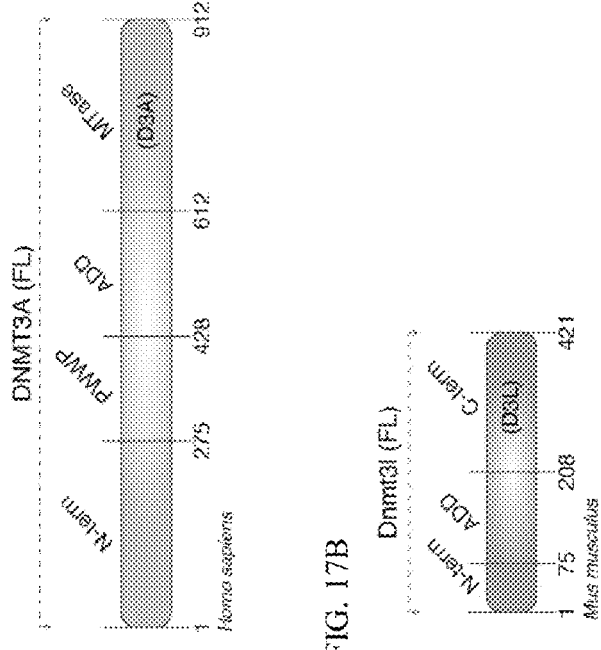
FIG. 17C
FIG. 17D
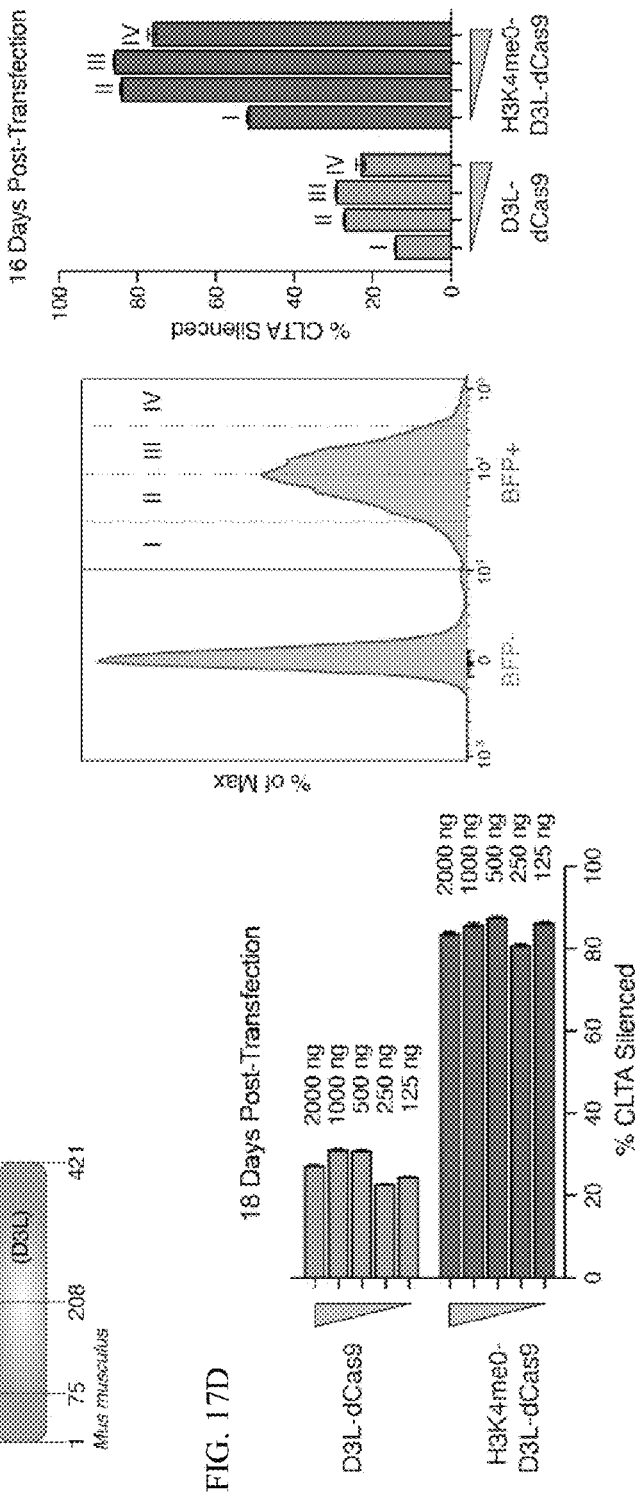
FIG. 17E
FIG. 17F

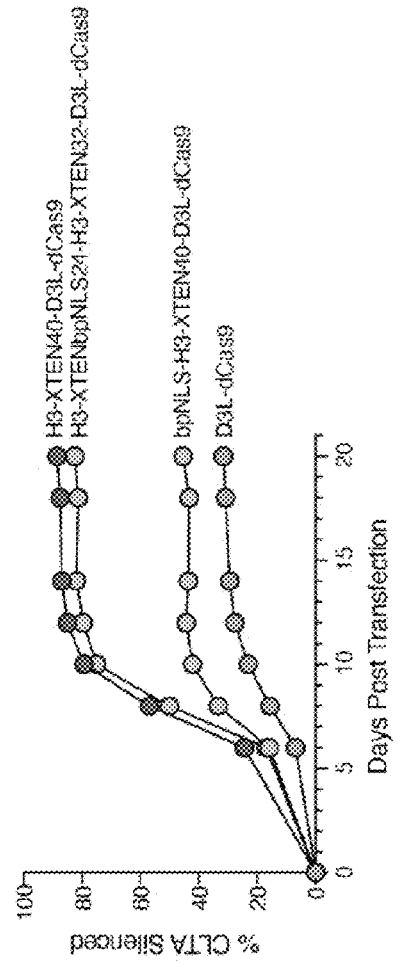
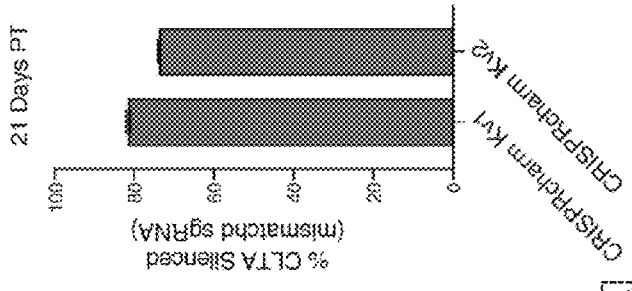
FIG. 17G
FIG. 17H
FIG. 17I

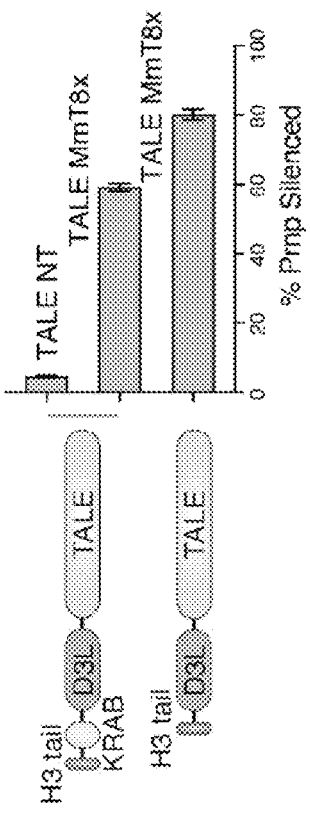
FIG. 19A
FIG. 19B
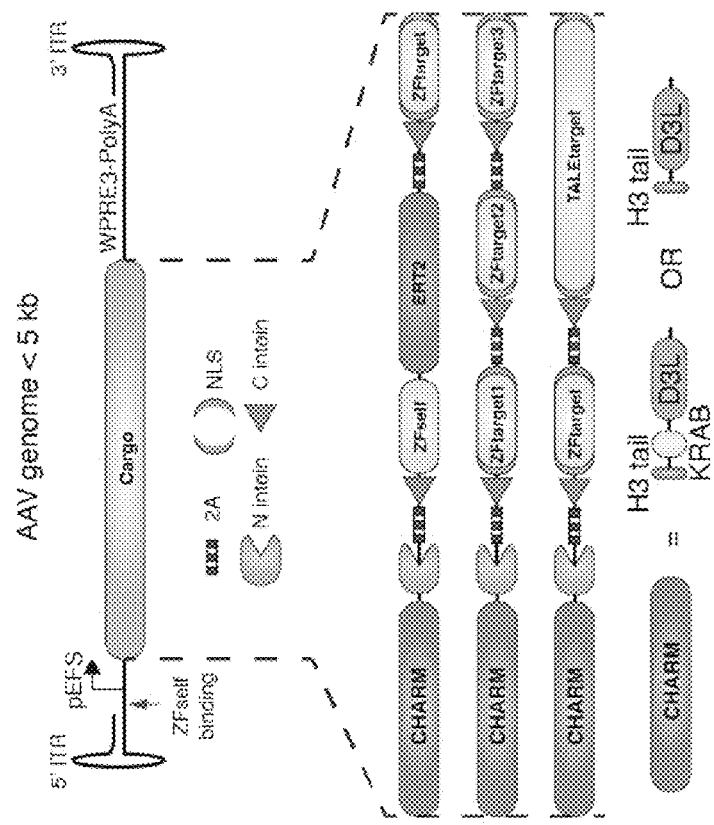
FIG. 19C
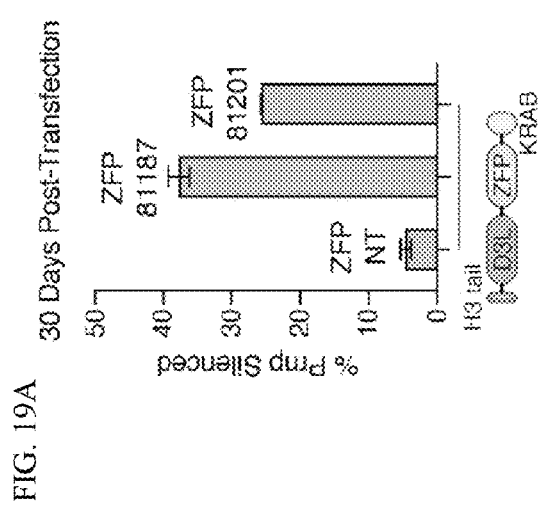
FIG. 19D
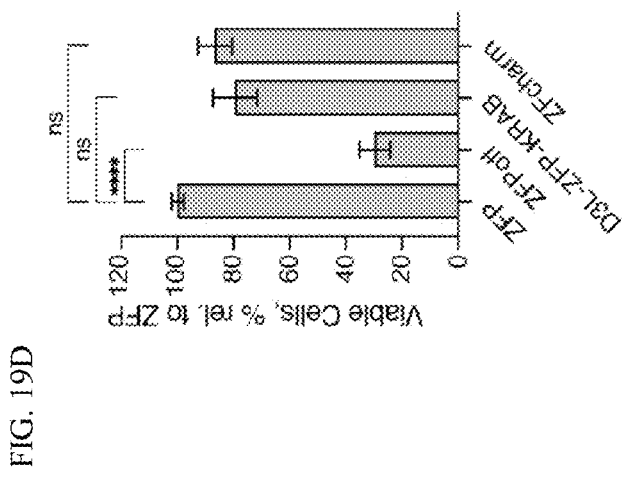

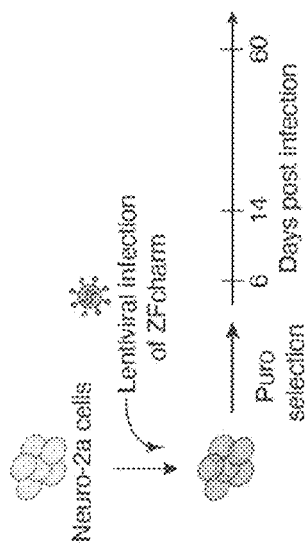
FIG. 22A
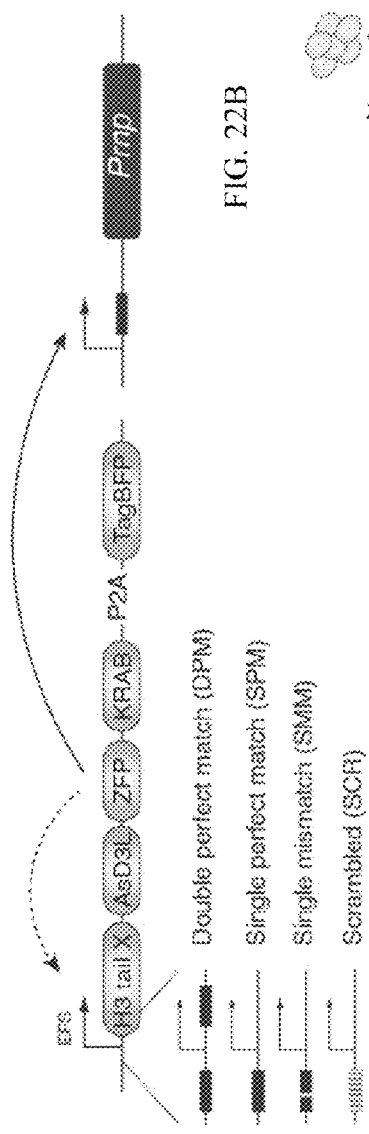
FIG. 22B
FIG. 22C
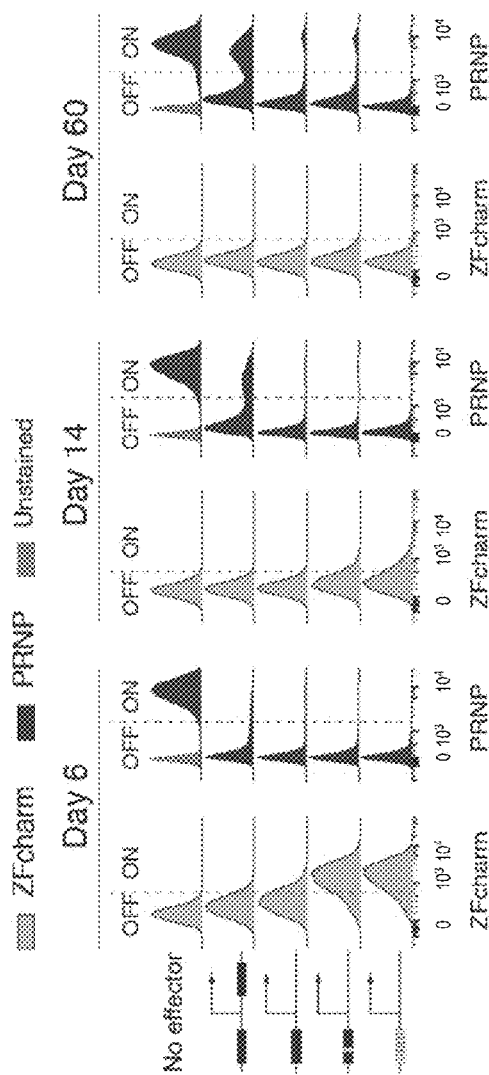

COMPOSITIONS AND METHODS FOR MAKING EPIGENETIC MODIFICATIONS

RELATED APPLICATIONS

This application claims the benefit of U.S. Provisional Application No. 63/485,860, filed on Feb. 17, 2023, and claims the benefit of U.S. Provisional Application No. 63/520,594, filed on Aug. 18, 2023. The entire teachings of the above applications are incorporated herein by reference.

GOVERNMENT SUPPORT

This invention was made with government support under grant numbers 5U19NS132315 and NIH 1RM1 HG009490-06 CEGS from National Institutes of Health. The government has certain rights in the invention.

INCORPORATION BY REFERENCE OF MATERIAL IN XML

This application incorporates by reference the Sequence Listing contained in the following eXtensible Markup Language (XML) file being submitted concurrently herewith:
a) File name: 0399.2071-003.xml; created Feb. 16, 2024, 1,470,494 Bytes in size.

BACKGROUND

Programmable gene regulation is a promising therapeutic approach presenting several advantages over genetic engineering, including tunability, reversibility, and lack of DNA break-associated cytotoxicity. Epigenetic silencing works by introducing epigenetic modifications that decrease expression of a target gene rather than introducing a mutation in the target gene. As such, there is no risk of toxicity from chronic expression of a mutated message encoding for a damaged, truncated protein, which taxes a cell's nonsense-mediated decay machinery. However, therapeutic applications of the current programmable gene regulation designs face challenges. For example, overexpression of a potentially toxic enzyme, for example, a DNA methyltransferase, may result in off-target effects. Moreover, available constructs often exceed the packaging capacity of certain delivery vectors, such as adeno-associated virus (AAV) vectors. Accordingly, there is a need for more compact and less toxic epigenetic editors.

SUMMARY

The disclosure provided herein is based, in part, on the discovery that a fusion protein comprising a DNMT3L C-terminal domain and an unmethylated H3 tail can recruit endogenous DNMT3A methyltransferase to a predetermined genomic locus in a cell. The disclosure generally relates to compositions, such as fusion proteins, polynucleotides, vectors, gene delivery systems, cells, pharmaceutical compositions, kits, and methods that are useful for making epigenetic modifications.

In one aspect, the disclosure provides a fusion protein comprising a DNA-binding domain, a DNMT3 methyltransferase-binding domain, and a H3K4me0.

In another aspect, the disclosure provides a fusion protein comprising a nuclease sequence, a DNMT3 methyltransferase-binding domain, and a H3K4me0. In some embodiments, a nuclease sequence lacks nuclease activity (e.g., is nuclease-deficient).

In some embodiments, a fusion protein lacks nuclease activity. In some embodiments, a fusion protein further comprises a histone methyltransferase. In some embodiments, a fusion protein lacks a DNA methyltransferase catalytic domain.

In another aspect, the disclosure provides a polynucleotide encoding any one or more of the fusion proteins disclosed herein. In some embodiments, a polynucleotide is less than or equal to about 4.7 kb in length.

In another aspect, the disclosure provides a vector comprising any one or more of the polynucleotides disclosed herein. In some embodiments, a vector is less than or equal to about 4.7 kb in length.

In another aspect, the disclosure provides a gene delivery system comprising any one of the polynucleotides or vectors disclosed herein. In some embodiments, a gene delivery system comprises an adeno-associated viral vector (AAV).

In another aspect, the disclosure provides a composition comprising any one or more of the fusion proteins, polynucleotides, vectors, or gene delivery systems disclosed herein, or any combination of the foregoing. In some embodiments, a composition is a pharmaceutical composition.

In another aspect, the disclosure provides a kit comprising a container and, optionally, an instruction for use, wherein the container comprises any one or more of the fusion proteins, polynucleotides, vectors, gene delivery systems, compositions, or pharmaceutical compositions disclosed herein, or any combination of the foregoing.

In another aspect, the disclosure provides a cell comprising any one or more of the fusion proteins, polynucleotides, vectors, or gene delivery systems disclosed herein, or any combination of the foregoing.

In another aspect, the disclosure provides a progeny cell, wherein the progeny cell is derived from a cell comprising any one or more of the fusion proteins, polynucleotides, vectors, or gene delivery systems disclosed herein, or any combination of the foregoing.

In another aspect, the disclosure provides a method of epigenetically modifying a genomic locus in a cell, comprising delivering to the cell any one or more of the fusion proteins, polynucleotides, or vectors disclosed herein, or any combination of the foregoing.

In another aspect, the disclosure provides an epigenetically-modified cell produced by any one or more of the methods disclosed herein, or a progeny cell thereof.

In another aspect, the disclosure provides a method of treating a disease in a subject in need thereof, comprising administering to the subject any one or more of the fusion proteins, polynucleotides, gene delivery systems, compositions, pharmaceutical compositions, or cells disclosed herein. In some embodiments, a subject is a human.

BRIEF DESCRIPTION OF THE DRAWINGS

The patent or application file contains at least one drawing executed in color. Copies of this patent or patent application publication with color drawings will be provided by the Office upon request and payment of the necessary fee.

The foregoing will be apparent from the following more particular description of example embodiments, as illustrated in the accompanying drawings in which like reference characters refer to the same parts throughout the different views. The drawings are not necessarily to scale, emphasis instead being placed upon illustrating embodiments.

FIGS. 1A-1B Assay and epigenetic editor constructs. FIG. 1A A monoclonal HEK293T cell line was made by sorting single cells after tagging the CLTA gene with an mScarlet reporter and delivering a lentiviral vector containing mU6-sgRNA targeting the CLTA transcription start site. Transfected cells were sorted two days post-transfection and monitored for mScarlet silencing.

FIG. 1B A schematic of dCas9 epigenetic editor fusion proteins tested for silencing activity. D3L denotes Dnmt3l C-terminal domain.

FIGS. 2A-2B Reporter silencing time course. FIG. 2A Histograms of mScarlet fluorescence in cells of the mScarlet-CLTA monoclonal reporter cell line transiently transfected with the indicated epi-editor constructs. D3L, Dnmt3l C-terminal domain; PT, post-transfection.

FIG. 2B Time course plots of mScarlet fluorescence corresponding to the transfected cell line in FIG. 2A. Data are mean±SD of n=2 replicates.

FIG. 3A Percent mScarlet-CLTA reporter silencing at day 18 post-transfection with different amounts of DNA.

FIG. 3B Percent mScarlet-CLTA reporter silencing at day 16 post-transfection after sorting on different levels of protein expression from I (low) to IV (high). H3, H3K4me0. D3L, Dnmt3l C-terminal domain. Data are mean±SD of n=2 replicates.

FIG. 4A Percent mScarlet-CLTA reporter silencing over 3 weeks using different standard fusion protein linkers. FIG. 4B Percent mScarlet-CLTA reporter silencing over 3 weeks using N-term bpNLS signals and dual-H3 fusions. FIG. 4C Percent mScarlet-CLTA reporter silencing at day 15 post-transfection tiling different length linkers connecting H3 to D3L. H3, H3K4me0. H3mut, H3A4me0 mutant. D3L, Dnmt3l C-terminal domain. N-term bpNLS signals, N-terminal bipartite nuclear localization signals. Data are mean±SD of n=2 replicates.

FIG. 5A Phylogenetic tree of DNMT3L orthologs. Proteins with >5% reporter silencing activity are labeled. FIG. 5B Percent mScarlet-CLTA reporter silencing at day 16 post-transfection using D3L-dCas9 fusions. ASR, ancestral reconstruction. D3L, Dnmt3l C-terminal domain. Data are mean±SD of n=2 replicates.

FIG. 8A Schematics of histone tail-based epigenetic editors through multiple rounds of optimization. FIG. 8B Percent mScarlet-CLTA reporter silencing in a CLTA reporter cell line where each indicated epi-editor was transiently transfected. Data are mean±SD of n=2 replicates.

FIG. 12A Experimental design. FIG. 12B Flow cytometry data assessing epi-editor and target gene expression 6, 14, and 60 days post lentiviral transduction of self-silencing epi-editors in Neuro-2a cells. Epi-editor expression was measured via TagBFP fluorescence; target gene expression was measured using a fluorescence-conjugated antibody against the target gene product.

FIGS. 15A-15G PRNP is a viable target for epigenetic silencing, but existing technologies are not suitable for therapeutic use. FIG. 15A A HEK293T cell line was made by integrating a lentiviral vector containing mU6-sgRNA targeting the PRNP transcription start site (TSS). Transfected cells were sorted by FACS (TagBFP) two days post-transfection and monitored for PRNP silencing by Alexa Fluor 647 anti-PRNP staining and flow cytometry. FIG. 15B PRNP and effector expression time course of HEK293T cells transiently transfected with plasmids encoding CRISPRi and CRISPRoff effectors. Data are mean±SEM of n=2 replicates.

FIG. 15C DNA methylation assessment by targeted nanopore long read sequencing of native genomic DNA extracted from HEK293T cells 50 days post-transfection. FIG. 15D Mouse N2a cells co-transfected with plasmids encoding CRISPRi/CRISPRoff and three sgRNAs targeting the TSS of Prnp were assessed for Prnp expression and DNA methylation. Data are mean±SEM of n=2 replicates. FIG. 15E Schematic depicting AAV genome packaging constraints with CRISPRoff and ZFPoff to scale. FIGS. 15F-15G HEK293T cells were transiently transfected with ZFPoff and D3L-ZFP-KRAB and imaged after 6 days.

FIGS. 16A-16D Nanopore was performed in two biological replicates and Pearson correlation coefficient is shown. FIGS. 16E-16F HEK293T cells containing the mScarlet-CLTA reporter and constitutively expressing sgRNA targeting the CLTA TSS and a full-length DNMT3A-EGFP fusion were transfected with an effector fusion of dCas9, D3L, KRAB, and the GFP nanobody (GNb). Cells were monitored for reporter silencing by flow cytometry. Data are mean±SEM of n=2 replicates.

FIGS. 17A-17I CHARM dose-titration and optimization schematics. FIG. 17A Schematic of DNMT3A1 domains. FIG. 17B Schematic of DNMT3L domains. FIG. 17C HEK293T cells containing the mScarlet-CLTA reporter and sgRNA against the CLTA TSS were targeted by effectors containing full-length (FL) or catalytic-only (D3A) fusions of DNMT3A with D3L-dCas9 and monitored for silencing by flow cytometry. Data are mean±SEM of n=2 replicates. FIG. 17D mScarlet-CLTA reporter HEK293T cells were transiently transfected with different nanogram (ng) amounts of plasmid DNA encoding D3L-dCas9 or a CHARM effector. Data are mean±SEM of n=2 replicates. FIGS. 17E-17F mScarlet-CLTA reporter HEK293T cells were transiently transfected with plasmids encoding D3L-dCas9 or CHARM effectors and sorted into four bins based on transgene expression level. Data are mean±SEM of n=2 replicates.

FIG. 17G mScarlet-CLTA reporter HEK293T cells were transiently transfected with different plasmids encoding D3L-dCas9 or a CHARM effector with varying N-terminal appendages. Data are mean±SEM of n=2 replicates. FIG. 17H Schematics of the full optimization history and nomenclature for non-limiting examples of CRISPRcharm effectors. The term "kv1" is added when a CRISPRcharm effector comprises a KRAB domain at its C-terminus. CRISPRcharm3 is also referred to as CRISPRcharm; CRISPRcharm3 Kv1 is also referred to as CRISPRcharm Kv1; and CRISPRcharm3 Kv2 is also referred to as CRISPRcharm Kv2. FIG. 17I mScarlet-CLTA reporter HEK293T cells with a mismatched sgRNA against the CLTA TSS to improve dynamic range of silencing were transiently transfected with plasmids encoding either CRISPRcharm Kv1 or CRISPRcharm Kv2 effectors. Data are mean±SEM of n=2 replicates.

FIG. 18A Cartoon depiction of endogenous DNMT3A recruitment and activation by an unlimited example of the CHARM system. FIG. 18B Time course of effector (TagBFP) and mScarlet-CLTA reporter expression after transient transfection with effector-containing plasmids. Data are mean±SEM of n=2 replicates. FIG. 18C First pass histone H3 tail fusion test on the mScarlet-CLTA reporter using different linkers to D3L. FIG. 18D Refinement of linker sequence between H3 tail and D3L. Data are mean±SEM of n=2 replicates. FIG. 18E Phylogenetic tree of DNMT3L orthologs and ancestral reconstruction nodes. Orthologs with measured silencing activity >5% by 14 days are labeled.

FIG. 18F Repression of mScarlet-CLTA reporter 2 weeks post-transfection with different DNMT3L ortholog C-terminal domains fused to dCas9. Data are mean±SEM of n=2 replicates.

FIG. 18G Transient transfection and repression of mScarlet-CLTA reporter with different length histone H3 domains (FL; full length). A mismatched sgRNA against CLTA TSS is used to improve dynamic range. Data are mean±SEM of n=2 replicates. FIG. 18H Time course of effector expression and mScarlet-CLTA silencing comparing CRISPRoff and CRISPRi against the series of optimized CHARM constructs. Data are mean±SEM of n=2 replicates. FIG. 18I Comparison of CRISPRi, CRISPRoff, and the optimized CRISPRcharm effectors in silencing cell surface markers. Plasmids were transiently co-transfected with vectors encoding mU6-sgRNAs. Data are mean±SEM of n=2 replicates.

FIGS. 19A-19F CHARM is flexible and specific. FIG. 19A Mouse N2a cells were transiently transfected with plasmids encoding ZFcharm Kv1 constructed with the mouse Prnp-targeting ZFP 81187, ZFP 81201, or a non-targeting ZFP and stained with Alexa Fluor 647 anti-PRNP. Data are mean±SEM of n=2 replicates. FIG. 19B Mouse N2a cells were transiently transfected with TALEcharm and TALEcharm Kv2 composed of engineered TALE proteins targeting the mouse Prnp TSS or a non-targeting TALE, then measured using Alexa Fluor 647 anti-PRNP. Data are mean±SEM of n=2 replicates. FIG. 19C Schematic of possible AAV packaging strategies using space-saving techniques like split-inteins[19] or a self-silencing approach including the tamoxifen-inducible engineered estrogen receptor ERT2[21]. WPRE3 is a structured 3' element for mRNA stability[56]. FIG. 19D HEK293T cells were transiently transfected with plasmids encoding ZFP81187 alone or the fusions ZFPoff, D3L-ZFP-KRAB, and ZFcharm Kv1 and then counted by flow cytometry after cell viability staining with LIVE/DEAD near-IR dye. Data are mean±SEM of n=3 replicates. FIG. 19E ZFcharm Kv1 using ZFP 81201 targeting the mouse Prnp TSS was introduced into N2a cells by lentiviral transduction and assessed for knockdown and specificity by RNA sequencing after 4 weeks. FIG. 19F CRISPRcharm Kv1 with sgRNA targeting the mouse Prnp TSS or a non-targeting sgRNA were introduced into N2a cells by lentiviral transduction and assessed by Prnp knockdown and specificity by RNA sequencing after 4 weeks.

FIG. 20A HEK293T cells were transduced with lentivirus encoding ZFcharm Kv1 with ZFPs targeting the human PRNP TSS. Direct fusions and split-intein CHARMs are equally effective in PRNP repression as measured by Alexa Fluor 647 anti-PRNP. FIG. 20B HEK293T cells containing the mScarlet-CLTA reporter and SaCas9 sgRNA against the CLTA TSS were transiently transfected with a CRISPRcharm construct using dSaCas9 as the DNA-binding domain. These were monitored for CLTA silencing by flow cytometry. FIG. 20C Quantified Prnp RNA levels in N2a cells transduced with ZFcharm Kv1 or CRISPRcharm Kv1 lentiviral constructs corresponding to FIGS. 19E-19F). Data are mean±SEM of n=2 replicates.

FIG. 21A Schematic of experimental design. FIG. 21B PRNP ELISA and Prnp RT-qPCR data generated from brain hemisphere homogenate 6 weeks post injection of 1.5e13 vg/kg AAV. FIG. 21C AAV dose-response analysis using KRAB-containing ZFcharm. FIG. 21D Quantification of DNA methylation at the Prnp promoter in treated and untreated brains 6 weeks post injection. 5mCpG was detected through target-enriched nanopore sequencing. FIGS. 21E-21F Visualization of Prnp (yellow) and pan-neuronal marker Uchl1 (magenta) expression in 10 μm coronal brain sections via HCR RNA-FISH (DAPI staining in blue). FIG. 21E Representative maximum-intensity projections of coronal brain hemisphere tile scans. White boxes indicate brain regions shown in panel F. Scale bar, 1 mm. FIG. 21F Zoomed-in views of the cortex (CTX), hippocampus (HP), and thalamus (TH). Scale bar, 100 μm. FIG. 21G Single-cell identification of Prnp+(yellow) and Prnp-(magenta) neurons in the coronal brain hemispheres shown in panel E. Prnp-expressing Uchl1+ neurons were identified via machine learning classification using QuPath software[59]. Cell boundaries represent 4 µm expansions from DAPI-detected nuclei. FIG. 21H Representative histograms of mean Prnp intensity in neurons.

FIGS. 22A-22H CHARMs can be programmed for transient expression through self-silencing. FIG. 22A Schematic of the experimental approach used to develop self-silencing ZFcharms. FIG. 22B Quantification of self-silencing kinetics by measuring ZFcharm and Prnp expression over time following lentiviral transduction of N2a cells. FIG. 22C Flow cytometry histograms of ZFcharm (orange; TagBFP) and PRNP (navy; Alexa Fluor 647 anti-CD230) expression at days 6, 14, and 60 post infection. FIG. 22D Clonal bisulfite sequencing of EFS promoters driving ZFcharm-SCR and ZF-charm-SPM expression 5 and 25 days post infection. Percent 5mCpG (black) is calculated for each CpG site across PCR clones and depicted as a pie chart. The positions of the CAAT box, EFP1, EFP2, TATA box, initiator element, and TSS site within the EFS promoter are shown in the schematic under the data. CpGs between the TATA box and TSS are highlighted in gray and the ZF binding site is highlighted in orange. FIG. 22E 60-day flow cytometry time course monitoring ZFcharm and PRNP expression across ZF-SPM constructs. FIG. 22F ZFcharm-SPM and PRNP expression quantified by flow cytometry 6 months post infection. FIG. 22G Schematic of experimental strategy to engineer a modular self-silencing ZFcharm using two distinct ZF domains. FIG. 22H Tuning of self-silencing kinetics using an allelic series of ZF3 backbone RtoA mutations. ZFcharm (orange; mCherry) and PRNP (navy; Alexa Fluor 647 anti-CD230) expression were quantified by flow cytometry 9 and 22 days post infection.

FIG. 23A ZFcharm and Prnp expression over time following transfection of piggyBac donor and transposase plasmids in N2a cells. FIG. 23B Clonal bisulfite sequencing of EFS promoter driving ZFcharm-SCR and ZF-charm-SPM expression 5 and 25 days post infection. Each line is an individual PCR clone. Circles depict methylated (black) and unmethylated (white) CpG sites. Sequence elements within the EFS promoter are shown in the schematics under the data. CpGs between the TATA box and TSS are highlighted in gray. FIG. 23C Bar chart showing average % 5mCpG between the TATA box and TSS FIG. 23D Flow cytometry histograms of ZF editor and PRNP expression 6 and 60 days post infection across ZF-SPM constructs.

FIG. 24A Placing the KRAB domain in the linker region between the H3 tail and D3L is tolerated when using ZF-mediated DNA binding, as shown above for dCas9-based targeting (fig. S2H). FIG. 24B ZFcharm with a ZF3 DNA binding domain can rapidly silence itself. FIG. 24C Placing NLS sequences on both the N- and C-exteins improves self-silencing. FIG. 24D Schematic of an alternative approach to tuning a modular self-silencing ZFcharm. FIG. 24E Introducing point mutations into the ZF3 binding site upstream of the EFS promoter slows the rate of self-silencing. All flow cytometry data shown in this figure is representative of 2 technical replicates and was collected at the indicated days post lentiviral transduction of N2a cells.

FIG. 25A Schematic of experimental design. FIGS. 25B-25C PRNP ELISA and Prnp RT-qPCR data generated from brain hemisphere homogenate 6 weeks post injection of 1.5e13 vg/kg AAV. AAV capsids were packaged with self-silencing ZFcharm constructs containing (FIG. 25B) or lacking (FIG. 25C) the KRAB domain. FIGS. 25D-25E Clonal bisulfite sequencing of the EFS promoter driving expression of self-silencing ZFcharm constructs containing (FIG. 25D) or lacking (FIG. 25E) the KRAB domain. Percent 5mCpG (black) is calculated for each CpG site across PCR clones and depicted as a pie chart. Sequence elements within the EFS promoter are shown in the schematic under the data. CpGs between the TATA box and TSS are highlighted in gray and the ZF binding site is highlighted in orange.

FIGS. 26A-26B Clonal bisulfite sequencing of EFS promoter driving self-silencing ZFcharm constructs in vivo. Each line is an individual PCR clone. Circles depict methylated (black) and unmethylated (white) CpG sites. Sequence elements within the EFS promoter are shown in the schematics under the data. CpGs between the TATA box and TSS are highlighted in gray and the ZF binding site is highlighted in orange. FIG. 26C Bar chart showing average percent 5mCpG between the TATA box and TSS. FIG. 26D Clonal bisulfite sequencing of EFS promoter in single-stranded AAV genomic DNA extracted from ZFcharm-SPM virus.

FIG. 27A Schematic of experimental design. FIG. 27B PRNP ELISA and Prnp RT-qPCR data generated from brain hemisphere homogenate 13 weeks post injection of 1.5e13 vg/kg AAV. FIG. 27C Clonal bisulfite sequencing of the EFS promoter driving expression of self-silencing ZFcharm 13 weeks post AAV infection. Each line is an individual PCR clone. Circles depict methylated (black) and unmethylated (white) CpG sites. Sequence elements within the EFS promoter are shown in the schematic under the data. CpGs between the TATA box and TSS are highlighted in gray and the ZF binding site is highlighted in orange. FIG. 27D Bar chart showing average percent 5mCpG between the TATA box and TSS.

FIG. 28A Target-enriched nanopore sequencing of Prnp promoter in brains harvested 13 weeks post AAV injection. FIG. 28B 5mCpG quantification via nanopore sequencing is reproducible. Percent 5mCpG is compared between two biological replicates for each condition. Pearson correlations are shown on each graph.

DETAILED DESCRIPTION

Figure 3B:
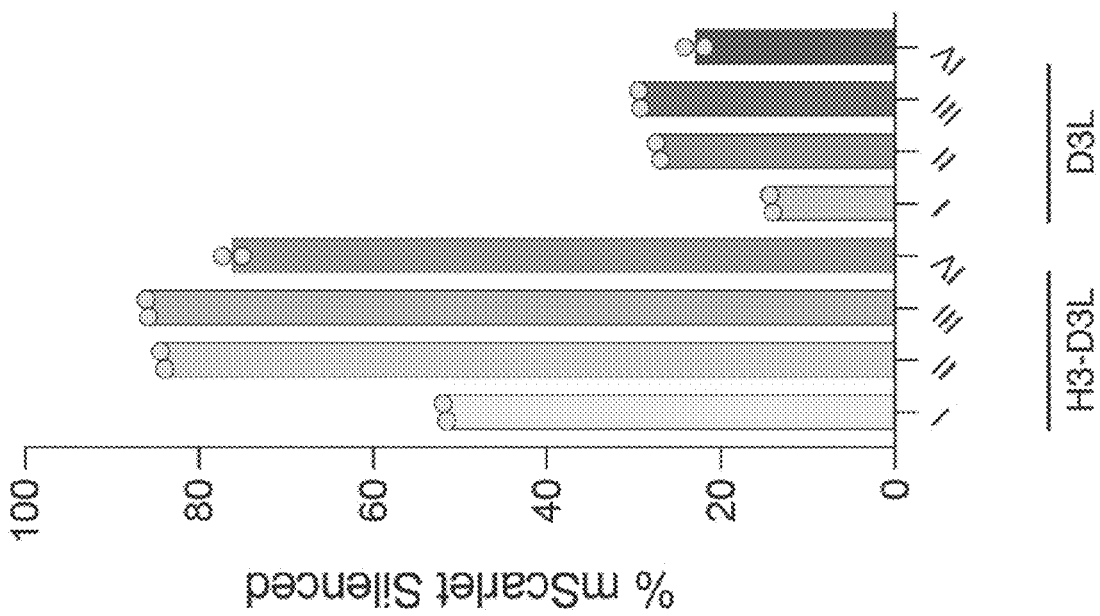
FIGS. 3A-3B Editor was not dose or expression-limited.

A description of example embodiments follows.

Unless otherwise defined, all terms of art, notations and other scientific terms or terminology used herein are intended to have the meanings commonly understood by those of skill in the art to which this disclosure pertains. In some cases, terms with commonly understood meanings are defined herein for clarity and/or for ready reference, and the inclusion of such definitions herein should not necessarily be construed to represent a substantial difference over what is generally understood in the art. It will be further understood that terms, such as those defined in commonly used dictionaries, should be interpreted as having a meaning that is consistent with their meaning in the context of the relevant art and/or as otherwise defined herein.

Definitions

Certain terms used herein is for the purpose of describing particular embodiments only and is not intended to be limiting.

As used herein, the term "a," "an," or "the" should be understood to include plural reference unless the context clearly indicates otherwise.

As used herein, unless the context requires otherwise, the term "comprise," and variations such as "comprises" and "comprising", will be understood to imply the inclusion of, e.g., a stated integer or step or group of integers or steps, but not the exclusion of any other integer or step or group of integer or step. As used herein, the term "comprising" can be substituted with the term "containing" or "including."

As used herein, "consisting of" excludes any element, step, or ingredient not specified in the claim element. As used herein, "consisting essentially of" does not exclude materials or steps that do not materially affect the basic and novel characteristics of the claim. Any of the terms "comprising," "containing," "including," and "having," whenever used herein in the context of an aspect or embodiment of the disclosure, can in some embodiments, be replaced with the term "consisting of," or "consisting essentially of" to vary scopes of the disclosure.

As used herein, the conjunctive term "and/or" between multiple recited elements is understood as encompassing both individual and combined options. For instance, where two elements are conjoined by "and/or," a first option refers to the applicability of the first element without the second. A second option refers to the applicability of the second element without the first. A third option refers to the applicability of the first and second elements together. Any one of these options is understood to fall within the meaning, and, therefore, satisfy the requirement of the term "and/or" as used herein. Concurrent applicability of more than one of the options is also understood to fall within the meaning, and, therefore, satisfy the requirement of the term "and/or."

When a list is presented, unless stated otherwise, it is to be understood that each individual element of that list, and every combination of that list, is a separate embodiment. For example, a list of embodiments presented as "A, B, or C" is to be interpreted as including the embodiments, "A," "B," "C," "A or B," "A or C," "B or C," or "A, B, or C."

Unless otherwise indicated or otherwise evident from the context and/or understanding of one of ordinary skill in the art, values herein that are expressed as ranges can assume any specific value or sub-range within the stated ranges in different embodiments disclosed herein, to the tenth of the unit of the lower limit of the range, unless the context clearly dictates otherwise.

"About" means within an acceptable error range for the particular value, as determined by one of ordinary skill in the art. Typically, an acceptable error range for a particular value depends, at least in part, on how the value is measured or determined, e.g., the limitations of the measurement system. For example, "about" can mean within an acceptable standard deviation, per the practice in the art. Alternatively, "about" can mean a range of ±20%, e.g., ±10%, ±5% or ±1% of a given value. It is to be understood that the term "about" can precede any particular value specified herein, except for particular values used in the Exemplification. Whenever the term "about" precedes the first numerical value in a series of two or more numerical values, the term "about" applies to each of the numerical values in that series of numerical values. For example, about 1 to 3 is equivalent to about 1 to about 3.

Whenever the term "at least," "greater than," or "greater than or equal to" precedes the first numerical value in a series of two or more numerical values, the term "at least," "greater than" or "greater than or equal to" applies to each of the numerical values in that series of numerical values. For example, greater than or equal to 1, 2, or 3 is equivalent to greater than or equal to 1, greater than or equal to 2, or greater than or equal to 3.

Whenever the term "no more than," "less than," or "less than or equal to" precedes the first numerical value in a series of two or more numerical values, the term "no more than," "less than," or "less than or equal to" applies to each of the numerical values in that series of numerical values. For example, less than or equal to 3, 2, or 1 is equivalent to less than or equal to 3, less than or equal to 2, or less than or equal to 1.

The term "fusion protein" refers to a synthetic, semi-synthetic or recombinant single protein molecule. A fusion protein can comprise all or a portion of two or more different proteins and/or polypeptides that are attached by covalent bonds (e.g., peptide bonds). The term "polypeptide" "peptide" or "protein" denotes a polymer of at least two amino acids covalently linked by an amide bond, regardless of length or post-translational modification (e.g., glycosylation or phosphorylation). A fusion protein can comprise any suitable L- and/or D-amino acid, for example, common α-amino acids (e.g., alanine, glycine, valine), non-α-amino acids (e.g., β-alanine, 4-aminobutyric acid, 6-aminocaproic acid, sarcosine, statine), and unusual amino acids (e.g., citrulline, homocitruline, homoserine, norleucine, norvaline, ornithine). The amino, carboxyl and/or other functional groups in a fusion protein can be free (e.g., unmodified) or protected with a suitable protecting group. Suitable protecting groups for amino and carboxyl groups, and methods for adding or removing protecting groups are known in the art and are disclosed in, for example, Green and Wuts, Protecting Groups in Organic Synthesis, John Wiley and Sons, 1991. The functional groups of a fusion protein can also be derivatized (e.g., alkylated) or labeled (e.g., with a detectable label, such as a fluorogen or a hapten) using methods known in the art. A fusion protein can comprise one or more modifications (e.g., amino acid linkers, acylation, acetylation, amidation, methylation, terminal modifiers (e.g., cyclizing modifications), N-methyl-α-amino group substitution), if desired. In addition, a fusion protein can be an analog of a known and/or naturally-occurring peptide, for example, a peptide analog having conservative amino acid residue substitution(s).

As used herein, the term "sequence identity" refers to the extent to which two nucleotide sequences, or two amino acid sequences, have the same residues at the same positions when the sequences are aligned to achieve a maximal level of identity, expressed as a percentage. For sequence alignment and comparison, typically one sequence is designated as a reference sequence, to which a test sequences are compared. The sequence identity between reference and test sequences is expressed as the percentage of positions across the entire length of the reference sequence where the reference and test sequences share the same nucleotide or amino acid upon alignment of the reference and test sequences to achieve a maximal level of identity. As an example, two sequences are considered to have 70% sequence identity when, upon alignment to achieve a maximal level of identity, the test sequence has the same nucleotide or amino acid residue at 70% of the same positions over the entire length of the reference sequence.

Alignment of sequences for comparison to achieve maximal levels of identity can be readily performed by a person of ordinary skill in the art using an appropriate alignment method or algorithm. In some instances, the alignment can include introduced gaps to provide for the maximal level of identity. Examples include the local homology algorithm of Smith & Waterman, *Adv. Appl. Math.* 2:482 (1981), the homology alignment algorithm of Needleman & Wunsch, *J. Mol. Biol.* 48:443 (1970), the search for similarity method of Pearson & Lipman, *Proc. Nat'l. Acad. Sci.* USA 85:2444 (1988), computerized implementations of these algorithms (GAP, BESTFIT, FASTA, and TFASTA in the Wisconsin Genetics Software Package, Genetics Computer Group, 575 Science Dr., Madison, Wis.), and visual inspection (see generally Ausubel et al., *Current Protocols in Molecular Biology*).

When using a sequence comparison algorithm, test and reference sequences are input into a computer, subsequent coordinates are designated, if necessary, and sequence algorithm program parameters are designated. The sequence comparison algorithm then calculates the percent sequence identity for the test sequence(s) relative to the reference sequence, based on the designated program parameters. A commonly used tool for determining percent sequence identity is Protein Basic Local Alignment Search Tool (BLASTP) available through National Center for Biotechnology Information, National Library of Medicine, of the United States National Institutes of Health. (Altschul et al., 1990).

In some embodiments, an amino acid substitution is a conservative substitution. The term "conservative amino acid substitution(s)" or "conservative substitution(s)" refers to an amino acid substitution having a value of 0 or greater in BLOSUM62.

In some embodiments, an amino acid substitution is a highly conservative substitution. The term "highly conservative amino acid substitution(s)" or "highly conservative substitution(s)" refers to an amino acid substitution having a value of at least 1 (e.g., at least 2) in BLOSUM62.

The term "polynucleotide" refers to a biopolymer comprising naturally occurring deoxyribonucleotide monomers, non-naturally occurring deoxyribonucleotide monomers (e.g., 7-deazaguanosine, inosine, or a methylated nucleotide such as 5-methyl dCTP or 5-hydroxymethyl cytosine), naturally occurring ribonucleotide monomers, or non-naturally occurring ribonucleotide monomers (e.g., a locked nucleic acid (LNA)), or a combination thereof. A polynucleotide described herein can be single stranded (ss) or double stranded (ds). In some embodiments, a polynucleotide described herein is a DNA molecule. In some embodiments, a polynucleotide described herein is an RNA molecule (e.g., a linear or a circular RNA molecule).

The term "encoding" refers to specific sequences of nucleotides in a polynucleotide, such as a DNA (e.g., a cDNA) or an RNA (e.g., an mRNA), that serve as a template for synthesis of a protein having a defined sequence of amino acids. Unless otherwise specified, a polynucleotide encoding an amino acid sequence can have any one nucleic acid sequence of all nucleic acid sequences that are degenerate versions of each other and that encode the amino acid sequence.

The term "vector" refers to a nucleic acid molecule which may be employed to introduce a nucleic acid sequence or gene into a cell, either in vitro, ex vivo, or in vivo.

The term "ex vivo" refers to methods conducted within or on cells or tissue in an artificial environment outside an organism with minimum alteration of natural conditions.

The term "in vivo" refers to a method that is conducted within living organisms in their normal, intact state.

The term "in vitro" method is conducted using components of an organism that have been isolated from its usual biological context.

The term "expression vector" refers to a replicable nucleic acid from which one or more proteins can be expressed when the expression vector is transformed into a suitable expression host cell.

The term "host" cell refers to a cell into which a polynucleotide has been introduced by molecular biology techniques. All techniques by which a polynucleotide can be introduced into a host cell, including transfection with viral vectors, transformation with plasmid vectors, and introduction of naked DNA by electroporation, lipofection, and particle gun acceleration are contemplated herein.

The term "promoter" refers to a region of DNA to which RNA polymerase binds and initiates the transcription of a gene.

The term "operably linked" means that the nucleic acid is positioned in the recombinant polynucleotide, e.g., vector, in such a way that enables expression of the nucleic acid under control of the element (e.g., promoter) to which it is linked.

The term "selectable marker element" is an element that confers a trait suitable for artificial selection. Selectable marker elements can be negative or positive selection markers.

The term "pharmaceutically acceptable" means that the substance or composition the phrase modifies is, within the scope of sound medical judgment, suitable for use in contact with the tissues of humans and lower animals without undue toxicity, irritation, allergic response and the like, and are commensurate with a reasonable benefit/risk ratio.

As used herein, the term "pharmaceutically acceptable salt" refers to those salts which are, within the scope of sound medical judgment, suitable for use in contact with the tissues of mammals without undue toxicity, irritation, allergic response and the like, and are commensurate with a reasonable benefit/risk ratio. Pharmaceutically acceptable salts are well known in the art. For example, S. M. Berge et al., describe pharmaceutically acceptable salts in detail in J. Pharmaceutical Sciences, 1977, 66, 1-19, the relevant teachings of which are incorporated herein by reference in their entirety. Pharmaceutically acceptable salts of the compounds described herein include salts derived from suitable inorganic and organic acids, and suitable inorganic and organic bases.

Examples of salts derived from suitable acids include salts of an amino group formed with inorganic acids such as hydrochloric acid, hydrobromic acid, phosphoric acid, sulfuric acid and perchloric acid, or with organic acids such as acetic acid, oxalic acid, maleic acid, tartaric acid, citric acid, succinic acid or malonic acid or by using other methods used in the art, such as ion exchange. Other pharmaceutically acceptable salts derived from suitable acids include adipate, alginate, ascorbate, aspartate, benzenesulfonate, benzoate, bisulfate, borate, butyrate, camphorate, camphorsulfonate, cinnamate, citrate, cyclopentanepropionate, digluconate, dodecylsulfate, ethanesulfonate, formate, fumarate, glucoheptonate, glycerophosphate, gluconate, glutarate, glycolate, hemisulfate, heptanoate, hexanoate, hydroiodide, hydroxybenzoate, 2-hydroxy-ethanesulfonate, hydroxymaleate, lactobionate, lactate, laurate, lauryl sulfate, malate, maleate, malonate, methanesulfonate, 2-naphthalenesulfonate, nicotinate, nitrate, oleate, oxalate, palmitate, pamoate, pectinate, persulfate, 2-phenoxybenzoate, phenylacetate, 3-phenylpropionate, phosphate, pivalate, propionate, pyruvate, salicylate, stearate, succinate, sulfate, tartrate, thiocyanate, p-toluenesulfonate, undecanoate, valerate salts, and the like.

Either the mono-, di- or tri-acid salts can be formed, and such salts can exist in either a hydrated, solvated or substantially anhydrous form.

Salts derived from appropriate bases include salts derived from inorganic bases, such as alkali metal, alkaline earth metal, and ammonium bases, and salts derived from aliphatic, alicyclic or aromatic organic amines, such as methylamine, trimethylamine and picoline, or $N^+((C_1-C_4)alkyl)_4$ salts. Representative alkali or alkaline earth metal salts include sodium, lithium, potassium, calcium, magnesium, barium and the like. Further pharmaceutically acceptable salts include, when appropriate, nontoxic ammonium, quaternary ammonium, and amine cations formed using counterions such as halide, hydroxide, carboxyl, sulfate, phosphate, nitrate, lower alkyl sulfonate and aryl sulfonate.

The term "subject" or "patient" refers to a mammal (e.g., a human). In some embodiments, a subject is a mammal selected from a dog, a cat, a mouse, a rat, a hamster, a guinea pig, a horse, a pig, a sheep, a cow, a chimpanzee, a macaque, a cynomolgus, and a human. In some embodiments, a subject is a primate. In some embodiments, a subject is a human.

The term "a therapeutically effective amount," "an effective amount" or "an effective dosage" is an amount effective, at dosages and for periods of time necessary, to achieve a desired therapeutic result (e.g., treatment, healing, inhibition or amelioration of physiological response or condition, etc.). The full therapeutic effect does not necessarily occur by administration of one dose and may occur only after administration of a series of doses. Thus, a therapeutically effective amount may be administered in one or more administrations. A therapeutically effective amount may vary according to factors such as disease state, age, sex, and weight of a mammal, mode of administration and the ability of a therapeutic, or combination of therapeutics, to elicit a desired response in an individual.

An effective amount of an agent to be administered can be determined by a clinician of ordinary skill using the guidance provided herein and other methods known in the art. Relevant factors include the given agent, the pharmaceutical formulation, the route of administration, the type of disease or disorder, the identity of the subject (e.g., age, sex, weight) or host being treated, and the like. For example, suitable dosages can be from about 0.001 mg/kg to about 100 mg/kg, from about 0.01 mg/kg to about 100 mg/kg, from about 0.01 mg/kg to about 10 mg/kg, from about 0.01 mg/kg to about 1 mg/kg body weight per treatment. Determining a dosage for a particular agent, subject and disease is well within the abilities of one of skill in the art. Preferably, a dosage does not cause or produces minimal adverse side effects.

Desired response or desired results include effects at the cellular level, tissue level, or clinical results. As such, "a therapeutically effective amount" or synonym thereto depends upon the context in which it is being applied. For example, in some embodiments, it is an amount of a composition sufficient to achieve a treatment response as compared to the response obtained without administration of the composition. In other embodiments, it is an amount that results in a beneficial or desired result in a subject as compared to a control. As defined herein, a therapeutically effective amount of a composition may be readily determined by one of ordinary skill by routine methods known in the art. Dosage regimen and route of administration may be adjusted to provide an optimum therapeutic response.

As used herein, the term "treating," or its equivalents (e.g., "treatment" or "treat"), refers to the medical management of a subject with the intent to improve, ameliorate, stabilize (i.e., not worsen), prevent or cure a disease, pathological condition, or disorder-such as the particular indications exemplified herein. This term includes active treatment (treatment directed to improve the disease, pathological condition, or disorder), causal treatment (treatment directed to the cause of the associated disease, pathological condition, or disorder), palliative treatment (treatment designed for the relief of symptoms), preventative treatment (treatment directed to minimizing or partially or completely inhibiting the development of the associated disease, pathological condition, or disorder); and supportive treatment (treatment employed to supplement another therapy). Treatment also includes diminishment of the extent of a disease or condition (e.g., a central nervous system (CNS) disease such as a prion disease); preventing spread of the disease or condition; delay or slowing the progress of the disease or condition; amelioration or palliation of the disease or condition; and remission (whether partial or total), whether detectable or undetectable. "Treatment" can also mean prolonging survival as compared to expected survival if not receiving treatment. Those in need of treatment include those already with the condition or disorder, as well as those prone to have the condition or disorder or those in which the condition or disorder is to be prevented.

The term "ameliorating" or "palliating" a disease or condition means that the extent and/or undesirable clinical manifestations of the disease, disorder, or condition are lessened and/or time course of the progression is slowed or lengthened, as compared to the extent or time course in the absence of treatment.

Provided herein, among other things, is a fusion protein comprising a DNA-binding domain, a DNMT3 methyltransferase-binding domain (e.g., DNMT3A-binding domain), and a H3K4me0.

Also provided herein, among other things, is a fusion protein comprising a nuclease sequence, a DNMT3 methyltransferase-binding domain (e.g., DNMT3A-binding domain), and a H3K4me0. In some embodiments, the nuclease sequence lacks nuclease activity. Such nucleases are referred to herein as "nuclease-deficient" nucleases.

In some embodiments, a fusion protein further comprises a Krüppel-associated box (KRAB) domain or a homologue thereof.

Target Sequences

As used herein, the term "a target sequence" refers to a polynucleotide sequence (e.g., a double stranded DNA sequence) bound by a fusion protein disclosed herein, either directly or indirectly (e.g., through an intermediary such as a guide-RNA).

In some embodiments, a target sequence is associated with a disease, disorder, or pathogenic condition.

In some embodiments, a target sequence is a hypomethylated nucleic acid sequence. In some embodiments, a target sequence is a hypermethylated nucleic acid sequence.

In some embodiments, a target sequence is an endogenous sequence of an endogenous gene of a cell (e.g., a host cell). In some embodiments, a target sequence is an exogenous sequence.

In some embodiments, a target sequence is within a region of a gene targeted for epigenetic editing. In some embodiments, a target sequence is within a transcriptional regulatory sequence (e.g., a promoter, an enhancer or a silencer) of a gene targeted for epigenetic editing. In some embodiments, a target sequence is within a promoter of a gene targeted for epigenetic editing. In some embodiments, a target sequence is within an enhancer of a gene targeted for epigenetic editing. In some embodiments, a target sequence is within a silencer of a gene targeted for epigenetic editing. In some embodiments, a target sequence is within an exon of a gene targeted for epigenetic editing. In some embodiments, a target sequence is within an intron of a gene targeted for epigenetic editing.

In some embodiments, a target sequence is within about 3,000 base pairs flanking a transcription start site of a gene (e.g., a target gene for epigenetic editing), for example, within about: 2,900, 2,800, 2,700, 2,600, 2,500, 2,400, 2,300, 2,200, 2,100, 2,000, 1,900, 1850, 1,800, 1750, 1,700, 1,650, 1,600, 1,550, 1,500, 1,450, 1,400, 1,350, 1,300, 1,250, 1,200, 1,150, 1,100, 1,050, 1,000, 950, 900, 850, 800, 750, 700, 650, 600, 550, 500, 450, 400, 350, 300, 250, 200, 150, 100, 90, 80, 70, 60 or 50, base pairs flanking a transcription start site of a gene (e.g., a target gene for epigenetic editing). In some embodiments, a target sequence is within about 3,000 base pairs downstream of a transcription start site of a gene (e.g., a target gene for epigenetic editing), for example, within about: 2,900, 2,800, 2,700, 2,600, 2,500, 2,400, 2,300, 2,200, 2,100, 2,000, 1,900, 1850, 1,800, 1750, 1,700, 1,650, 1,600, 1,550, 1,500, 1,450, 1,400, 1,350, 1,300, 1,250, 1,200, 1,150, 1,100, 1,050, 1,000, 950, 900, 850, 800, 750, 700, 650, 600, 550, 500, 450, 400, 350, 300, 250, 200, 150, 100, 90, 80, 70, 60 or 50, base pairs downstream of a transcription start site of a gene (e.g., a target gene for epigenetic editing). In some embodiments, a target sequence is within about 3,000 base pairs upstream of a transcription start site of a gene (e.g., a target gene for epigenetic editing), for example, within about: 2,900, 2,800, 2,700, 2,600, 2,500, 2,400, 2,300, 2,200, 2,100, 2,000, 1,900, 1850, 1,800, 1750, 1,700, 1,650, 1,600, 1,550, 1,500, 1,450, 1,400, 1,350, 1,300, 1,250, 1,200, 1,150, 1,100, 1,050, 1,000, 950, 900, 850, 800, 750, 700, 650, 600, 550, 500, 450, 400, 350, 300, 250, 200, 150, 100, 90, 80, 70, 60 or 50, base pairs upstream of a transcription start site of a gene (e.g., a target gene for epigenetic editing).

In some embodiments, a target sequence is within about 2,500 base pairs flanking a transcription start site of a gene (e.g., a target gene for epigenetic editing). In some embodiments, a target sequence is within about 2,500 base pairs downstream of a transcription start site of a gene (e.g., a target gene for epigenetic editing). In some embodiments, a target sequence is within about 2,500 base pairs upstream of a transcription start site of a gene (e.g., a target gene for epigenetic editing).

In some embodiments, a target sequence is within about 2,000 base pairs flanking a transcription start site of a gene (e.g., a target gene for epigenetic editing). In some embodiments, a target sequence is within about 2,000 base pairs downstream of a transcription start site of a gene (e.g., a target gene for epigenetic editing). In some embodiments, a target sequence is within about 2,000 base pairs upstream of a transcription start site of a gene (e.g., a target gene for epigenetic editing).

In some embodiments, a target sequence is within about 1,500 base pairs flanking a transcription start site of a gene (e.g., a target gene for epigenetic editing). In some embodiments, a target sequence is within about 1,500 base pairs downstream of a transcription start site of a gene (e.g., a target gene for epigenetic editing). In some embodiments, a target sequence is within about 1,500 base pairs upstream of a transcription start site of a gene (e.g., a target gene for epigenetic editing).

In some embodiments, a target sequence is within about 1,000 base pairs flanking a transcription start site of a gene (e.g., a target gene for epigenetic editing). In some embodiments, a target sequence is within about 1,000 base pairs downstream of a transcription start site of a gene (e.g., a target gene for epigenetic editing). In some embodiments, a target sequence is within about 1,000 base pairs upstream of a transcription start site of a gene (e.g., a target gene for epigenetic editing).

In some embodiments, a target sequence is within about 500 base pairs flanking a transcription start site of a gene (e.g., a target gene for epigenetic editing). In some embodiments, a target sequence is within about 500 base pairs downstream of a transcription start site of a gene (e.g., a target gene for epigenetic editing). In some embodiments, a target sequence is within about 500 base pairs upstream of a transcription start site of a gene (e.g., a target gene for epigenetic editing).

In some embodiments, a target sequence is within about 200 base pairs flanking a transcription start site of a gene (e.g., a target gene for epigenetic editing). In some embodiments, a target sequence is within about 200 base pairs downstream of a transcription start site of a gene (e.g., a target gene for epigenetic editing). In some embodiments, a target sequence is within about 200 base pairs upstream of a transcription start site of a gene (e.g., a target gene for epigenetic editing).

In some embodiments, a target sequence is within about 100 base pairs flanking a transcription start site of a gene (e.g., a target gene for epigenetic editing). In some embodiments, a target sequence is within about 100 base pairs downstream of a transcription start site of a gene (e.g., a target gene for epigenetic editing). In some embodiments, a target sequence is within about 100 base pairs upstream of a transcription start site of a gene (e.g., a target gene for epigenetic editing).

In some embodiments, a target sequence is within about 3,000 base pairs flanking a promoter sequence of a gene (e.g., a target gene for epigenetic editing), for example, within about: 2,900, 2,800, 2,700, 2,600, 2,500, 2,400, 2,300, 2,200, 2,100, 2,000, 1,900, 1850, 1,800, 1750, 1,700, 1,650, 1,600, 1,550, 1,500, 1,450, 1,400, 1,350, 1,300, 1,250, 1,200, 1,150, 1,100, 1,050, 1,000, 950, 900, 850, 800, 750, 700, 650, 600, 550, 500, 450, 400, 350, 300, 250, 200, 150, 100, 90, 80, 70, 60 or 50, base pairs flanking a promoter sequence of a gene (e.g., a target gene for epigenetic editing). In some embodiments, a target sequence is within about 3,000 base pairs downstream of a promoter sequence of a gene (e.g., a target gene for epigenetic editing), for example, within about: 2,900, 2,800, 2,700, 2,600, 2,500, 2,400, 2,300, 2,200, 2,100, 2,000, 1,900, 1850, 1,800, 1750, 1,700, 1,650, 1,600, 1,550, 1,500, 1,450, 1,400, 1,350, 1,300, 1,250, 1,200, 1,150, 1,100, 1,050, 1,000, 950, 900, 850, 800, 750, 700, 650, 600, 550, 500, 450, 400, 350, 300, 250, 200, 150, 100, 90, 80, 70, 60 or 50, base pairs downstream of a promoter sequence of a gene (e.g., a target gene for epigenetic editing). In some embodiments, a target sequence is within about 3,000 base pairs upstream of a promoter sequence of a gene (e.g., a target gene for epigenetic editing), for example, within about: 2,900, 2,800, 2,700, 2,600, 2,500, 2,400, 2,300, 2,200, 2,100, 2,000, 1,900, 1850, 1,800, 1750, 1,700, 1,650, 1,600, 1,550, 1,500, 1,450, 1,400, 1,350, 1,300, 1,250, 1,200, 1,150, 1,100, 1,050, 1,000, 950, 900, 850, 800, 750, 700, 650, 600, 550, 500, 450, 400, 350, 300, 250, 200, 150, 100, 90, 80, 70, 60 or 50, base pairs upstream of a promoter sequence of a gene (e.g., a target gene for epigenetic editing).

In some embodiments, a target sequence is within about 2,500 base pairs flanking a promoter sequence of a gene (e.g., a target gene for epigenetic editing). In some embodiments, a target sequence is within about 2,500 base pairs downstream of a promoter sequence of a gene (e.g., a target gene for epigenetic editing). In some embodiments, a target sequence is within about 2,500 base pairs upstream of a promoter sequence of a gene (e.g., a target gene for epigenetic editing).

In some embodiments, a target sequence is within about 2,000 base pairs flanking a promoter sequence of a gene (e.g., a target gene for epigenetic editing). In some embodiments, a target sequence is within about 2,000 base pairs downstream of a promoter sequence of a gene (e.g., a target gene for epigenetic editing). In some embodiments, a target sequence is within about 2,000 base pairs upstream of a promoter sequence of a gene (e.g., a target gene for epigenetic editing).

In some embodiments, a target sequence is within about 1,500 base pairs flanking a promoter sequence of a gene (e.g., a target gene for epigenetic editing). In some embodiments, a target sequence is within about 1,500 base pairs downstream of a promoter sequence of a gene (e.g., a target gene for epigenetic editing). In some embodiments, a target sequence is within about 1,500 base pairs upstream of a promoter sequence of a gene (e.g., a target gene for epigenetic editing).

In some embodiments, a target sequence is within about 1,000 base pairs flanking a promoter sequence of a gene (e.g., a target gene for epigenetic editing). In some embodiments, a target sequence is within about 1,000 base pairs downstream of a promoter sequence of a gene (e.g., a target gene for epigenetic editing). In some embodiments, a target sequence is within about 1,000 base pairs upstream of a promoter sequence of a gene (e.g., a target gene for epigenetic editing).

In some embodiments, a target sequence is within about 500 base pairs flanking a promoter sequence of a gene (e.g., a target gene for epigenetic editing). In some embodiments, a target sequence is within about 500 base pairs downstream of a promoter sequence of a gene (e.g., a target gene for epigenetic editing). In some embodiments, a target sequence is within about 500 base pairs upstream of a promoter sequence of a gene (e.g., a target gene for epigenetic editing).

In some embodiments, a target sequence is within about 200 base pairs flanking a promoter sequence of a gene (e.g., a target gene for epigenetic editing). In some embodiments, a target sequence is within about 200 base pairs downstream of a promoter sequence of a gene (e.g., a target gene for epigenetic editing). In some embodiments, a target sequence is within about 200 base pairs upstream of a promoter sequence of a gene (e.g., a target gene for epigenetic editing).

In some embodiments, a target sequence is within about 100 base pairs flanking a promoter sequence of a gene (e.g., a target gene for epigenetic editing). In some embodiments, a target sequence is within about 100 base pairs downstream of a promoter sequence of a gene (e.g., a target gene for epigenetic editing). In some embodiments, a target sequence is within about 100 base pairs upstream of a promoter sequence of a gene (e.g., a target gene for epigenetic editing).

In some embodiments, a target sequence is within about 3,000 base pairs flanking an enhancer sequence of a gene (e.g., a target gene for epigenetic editing), for example, within about: 2,900, 2,800, 2,700, 2,600, 2,500, 2,400, 2,300, 2,200, 2,100, 2,000, 1,900, 1850, 1,800, 1750, 1,700, 1,650, 1,600, 1,550, 1,500, 1,450, 1,400, 1,350, 1,300, 1,250, 1,200, 1,150, 1,100, 1,050, 1,000, 950, 900, 850, 800, 750, 700, 650, 600, 550, 500, 450, 400, 350, 300, 250, 200, 150, 100, 90, 80, 70, 60 or 50, base pairs flanking an enhancer sequence of a gene (e.g., a target gene for epigenetic editing). In some embodiments, a target sequence is within about 3,000 base pairs downstream of an enhancer sequence of a gene (e.g., a target gene for epigenetic editing), for example, within about: 2,900, 2,800, 2,700, 2,600, 2,500, 2,400, 2,300, 2,200, 2,100, 2,000, 1,900, 1850, 1,800, 1750, 1,700, 1,650, 1,600, 1,550, 1,500, 1,450, 1,400, 1,350, 1,300, 1,250, 1,200, 1,150, 1,100, 1,050, 1,000, 950, 900, 850, 800, 750, 700, 650, 600, 550, 500, 450, 400, 350, 300, 250, 200, 150, 100, 90, 80, 70, 60 or 50, base pairs downstream of an enhancer sequence of a gene (e.g., a target gene for epigenetic editing). In some embodiments, a target sequence is within about 3,000 base pairs upstream of an enhancer sequence of a gene (e.g., a target gene for epigenetic editing), for example, within about: 2,900, 2,800, 2,700, 2,600, 2,500, 2,400, 2,300, 2,200, 2,100, 2,000, 1,900, 1850, 1,800, 1750, 1,700, 1,650, 1,600, 1,550, 1,500, 1,450, 1,400, 1,350, 1,300, 1,250, 1,200, 1,150, 1,100, 1,050, 1,000, 950, 900, 850, 800, 750, 700, 650, 600, 550, 500, 450, 400, 350, 300, 250, 200, 150, 100, 90, 80, 70, 60 or 50, base pairs upstream of an enhancer sequence of a gene (e.g., a target gene for epigenetic editing).

In some embodiments, a target sequence is within about 2,500 base pairs flanking an enhancer sequence of a gene (e.g., a target gene for epigenetic editing). In some embodiments, a target sequence is within about 2,500 base pairs downstream of an enhancer sequence of a gene (e.g., a target gene for epigenetic editing). In some embodiments, a target sequence is within about 2,500 base pairs upstream of an enhancer sequence of a gene (e.g., a target gene for epigenetic editing).

In some embodiments, a target sequence is within about 2,000 base pairs flanking an enhancer sequence of a gene (e.g., a target gene for epigenetic editing). In some embodiments, a target sequence is within about 2,000 base pairs downstream of an enhancer sequence of a gene (e.g., a target gene for epigenetic editing). In some embodiments, a target sequence is within about 2,000 base pairs upstream of an enhancer sequence of a gene (e.g., a target gene for epigenetic editing).

In some embodiments, a target sequence is within about 1,500 base pairs flanking an enhancer sequence of a gene (e.g., a target gene for epigenetic editing). In some embodiments, a target sequence is within about 1,500 base pairs downstream of an enhancer sequence of a gene (e.g., a target gene for epigenetic editing). In some embodiments, a target sequence is within about 1,500 base pairs upstream of an enhancer sequence of a gene (e.g., a target gene for epigenetic editing).

In some embodiments, a target sequence is within about 1,000 base pairs flanking an enhancer sequence of a gene (e.g., a target gene for epigenetic editing). In some embodiments, a target sequence is within about 1,000 base pairs downstream of an enhancer sequence of a gene (e.g., a target gene for epigenetic editing). In some embodiments, a target sequence is within about 1,000 base pairs upstream of an enhancer sequence of a gene (e.g., a target gene for epigenetic editing).

In some embodiments, a target sequence is within about 500 base pairs flanking an enhancer sequence of a gene (e.g., a target gene for epigenetic editing). In some embodiments, a target sequence is within about 500 base pairs downstream of an enhancer sequence of a gene (e.g., a target gene for epigenetic editing). In some embodiments, a target sequence is within about 500 base pairs upstream of an enhancer sequence of a gene (e.g., a target gene for epigenetic editing).

In some embodiments, a target sequence is within about 200 base pairs flanking an enhancer sequence of a gene (e.g., a target gene for epigenetic editing). In some embodiments, a target sequence is within about 200 base pairs downstream of an enhancer sequence of a gene (e.g., a target gene for epigenetic editing). In some embodiments, a target sequence is within about 200 base pairs upstream of an enhancer sequence of a gene (e.g., a target gene for epigenetic editing).

In some embodiments, a target sequence is within about 100 base pairs flanking an enhancer sequence of a gene (e.g., a target gene for epigenetic editing). In some embodiments, a target sequence is within about 100 base pairs downstream of an enhancer sequence of a gene (e.g., a target gene for epigenetic editing). In some embodiments, a target sequence is within about 100 base pairs upstream of an enhancer sequence of a gene (e.g., a target gene for epigenetic editing).

In some embodiments, a target sequence is within about 3,000 base pairs flanking a silencer sequence of a gene (e.g., a target gene for epigenetic editing), for example, within about: 2,900, 2,800, 2,700, 2,600, 2,500, 2,400, 2,300, 2,200, 2,100, 2,000, 1,900, 1850, 1,800, 1750, 1,700, 1,650, 1,600, 1,550, 1,500, 1,450, 1,400, 1,350, 1,300, 1,250, 1,200, 1,150, 1,100, 1,050, 1,000, 950, 900, 850, 800, 750, 700, 650, 600, 550, 500, 450, 400, 350, 300, 250, 200, 150, 100, 90, 80, 70, 60 or 50, base pairs flanking a silencer sequence of a gene (e.g., a target gene for epigenetic editing). In some embodiments, a target sequence is within about 3,000 base pairs downstream of a silencer sequence of a gene (e.g., a target gene for epigenetic editing), for example, within about: 2,900, 2,800, 2,700, 2,600, 2,500, 2,400, 2,300, 2,200, 2,100, 2,000, 1,900, 1850, 1,800, 1750, 1,700, 1,650, 1,600, 1,550, 1,500, 1,450, 1,400, 1,350, 1,300, 1,250, 1,200, 1,150, 1,100, 1,050, 1,000, 950, 900, 850, 800, 750, 700, 650, 600, 550, 500, 450, 400, 350, 300, 250, 200, 150, 100, 90, 80, 70, 60 or 50, base pairs downstream of a silencer sequence of a gene (e.g., a target gene for epigenetic editing). In some embodiments, a target sequence is within about 3,000 base pairs upstream of a silencer sequence of a gene (e.g., a target gene for epigenetic editing), for example, within about: 2,900, 2,800, 2,700, 2,600, 2,500, 2,400, 2,300, 2,200, 2,100, 2,000, 1,900, 1850, 1,800, 1750, 1,700, 1,650, 1,600, 1,550, 1,500, 1,450, 1,400, 1,350, 1,300, 1,250, 1,200, 1,150, 1,100, 1,050, 1,000, 950, 900, 850, 800, 750, 700, 650, 600, 550, 500, 450, 400, 350, 300, 250, 200, 150, 100, 90, 80, 70, 60 or 50, base pairs upstream of a silencer sequence of a gene (e.g., a target gene for epigenetic editing).

In some embodiments, a target sequence is within about 2,500 base pairs flanking a silencer sequence of a gene (e.g., a target gene for epigenetic editing). In some embodiments, a target sequence is within about 2,500 base pairs downstream of a silencer sequence of a gene (e.g., a target gene for epigenetic editing). In some embodiments, a target sequence is within about 2,500 base pairs upstream of a silencer sequence of a gene (e.g., a target gene for epigenetic editing).

In some embodiments, a target sequence is within about 2,000 base pairs flanking a silencer sequence of a gene (e.g., a target gene for epigenetic editing). In some embodiments, a target sequence is within about 2,000 base pairs downstream of a silencer sequence of a gene (e.g., a target gene for epigenetic editing). In some embodiments, a target sequence is within about 2,000 base pairs upstream of a silencer sequence of a gene (e.g., a target gene for epigenetic editing).

In some embodiments, a target sequence is within about 1,500 base pairs flanking a silencer sequence of a gene (e.g., a target gene for epigenetic editing). In some embodiments, a target sequence is within about 1,500 base pairs downstream of a silencer sequence of a gene (e.g., a target gene for epigenetic editing). In some embodiments, a target sequence is within about 1,500 base pairs upstream of a silencer sequence of a gene (e.g., a target gene for epigenetic editing).

In some embodiments, a target sequence is within about 1,000 base pairs flanking a silencer sequence of a gene (e.g., a target gene for epigenetic editing). In some embodiments, a target sequence is within about 1,000 base pairs downstream of a silencer sequence of a gene (e.g., a target gene for epigenetic editing). In some embodiments, a target sequence is within about 1,000 base pairs upstream of a silencer sequence of a gene (e.g., a target gene for epigenetic editing).

In some embodiments, a target sequence is within about 500 base pairs flanking a silencer sequence of a gene (e.g., a target gene for epigenetic editing). In some embodiments, a target sequence is within about 500 base pairs downstream of a silencer sequence of a gene (e.g., a target gene for epigenetic editing). In some embodiments, a target sequence is within about 500 base pairs upstream of a silencer sequence of a gene (e.g., a target gene for epigenetic editing).

In some embodiments, a target sequence is within about 200 base pairs flanking a silencer sequence of a gene (e.g., a target gene for epigenetic editing). In some embodiments, a target sequence is within about 200 base pairs downstream of a silencer sequence of a gene (e.g., a target gene for epigenetic editing). In some embodiments, a target sequence is within about 200 base pairs upstream of a silencer sequence of a gene (e.g., a target gene for epigenetic editing).

In some embodiments, a target sequence is within about 100 base pairs flanking a silencer sequence of a gene (e.g., a target gene for epigenetic editing). In some embodiments, a target sequence is within about 100 base pairs downstream of a silencer sequence of a gene (e.g., a target gene for epigenetic editing). In some embodiments, a target sequence is within about 100 base pairs upstream of a silencer sequence of a gene (e.g., a target gene for epigenetic editing).

A target gene for epigenetic editing can be of or derived from any organism and genome thereof. In some embodiments, a target gene for epigenetic editing is a prokaryotic gene. In some embodiments, a target gene for epigenetic editing is a eukaryotic gene, e.g., an animal gene (e.g., a fish gene or an avian gene) or a plant gene. In some embodiments, a target gene for epigenetic editing is a mammalian gene, e.g., a rodent gene (e.g., a mouse gene, a rat gene, a hamster gene, or a guinea pig gene), a horse gene, a pig gene, a sheep gene, a cow gene, or a primate gene (e.g., a chimpanzee gene, a macaque gene, a cynomolgus gene, or a human gene). In some embodiments, a target gene for epigenetic editing is a human gene.

Non-limiting examples of target genes for epigenetic editing include those encoding mutS homolog 2 (MSH2), mutL homolog 1 (MLH1), granulocyte-macrophage colony stimulating factor (GM-CSF), vascular endothelial growth factor (VEGF), erythropoietin (EPO), erb-b2 receptor tyrosine kinase 2 (ErbB2), somatotropin (GH), alpha globin (HBA), beta globin (HBB), gamma globin (HBG1), B-cell lymphoma/leukemia 11A (BCL11A), Krüppel-like factor 1 (KLF1), C-C chemokine receptor type 5 (CCR5), C—X—C chemokine receptor type 4 (CXCR4), protein phosphatase 1 regulatory subunit 12C (PPP1R12C), hypoxanthine phosphoribosyltransferase (HPRT), albumin, coagulation factor VIII, coagulation factor IX, leucine-rich repeat kinase 2 (LRRK2), Huntingtin (Htt), rhodopsin (RHO), cystic fibrosis transmembrane conductance regulator (CFTR), surfactant protein B (SFTPB), T-cell receptor alpha (TRAC), T-cell receptor beta (TRBC), programmed cell death 1 (PD1), cytotoxic T-lymphocyte antigen 4 (CTLA-4), human leukocyte antigen (HLA) A, HLA B, HLA C, proteasome subunit beta type-8 (PSMB8), transporter associated with antigen processing (TAP) 1, TAP2, tapasin (TAPBP), class II major histocompatibility complex transactivator (CITTA), dystrophin (DMD), glucocorticoid receptor (GR), interleukin 2 receptor subunit gamma (IL2RG), regulatory factor X5 (RFX5), fatty acid desaturase 2 (FAD2), fatty acid desaturase 3 (FAD3), ketoacyl-acyl carrier protein synthase II (KASII), malate dehydrogenase (MDH), microtubule associated protein tau (MAPT), apolipoprotein E (APOE) (e.g., apoE2, apoE3 or apoE4, for stroke, concussion and/or Alzheimer's disease (AD), and epilepsy), alpha-synuclein (SNCA), amyloid precursor protein (APP), presenilin 1 (PSEN1), presenilin 2 (PSEN2) (e.g., for AD), solute carrier family 6 member 4 (SLC6A4), 5-hydroxytryptamine receptor 2A (HTR2A), calcium voltage-gated channel subunit alpha1 C (CACNA1C), calcium voltage-gated channel auxiliary subunit beta 2 (CACNB2) (e.g., for depression and/or migraines), dystrophia myotonica-protein kinase (DMPK) (e.g., for myotonic dystrophy), calcium voltage-gated channel subunit alpha1 A (CACNA1A), sodium/potassium-transporting ATPase subunit alpha-2 (ATP1A2), sodium channel protein type 1 subunit alpha (SCN1A) (e.g., for migraine), Frataxin (FXN) (e.g., for Friedrich's Ataxia), peripheral myelin protein 22 (PMP22), utrophin (UTRN) (e.g., for Duchenne's muscular dystrophy), superoxide dismutase type 1 (SOD1), TAR DNA binding protein (TARDBP), fused in sarcoma (FUS), angiogenin (ANG), alsin Rho guanine nucleotide exchange factor (ALS2), senataxin (SETX), progranulin (GRN), VAMP associated protein B and C (VAPB) (e.g., for Amyotrophic lateral sclerosis (ALS) and/or dementia), fragile X messenger ribonucleoprotein 1 (FMR1) (e.g., for Fragile X), hypoxanthine-guanine phosphoribosyltransferase (HPRT) (e.g., for Lesch-Nyhan Disease), methyl CpG binding protein 2 (MECP2) (e.g., Rett syndrome), aspartoacylase (ASPA) (e.g., Canavan Disease), SCN8A (e.g., Dravet syndrome), UDP glucuronosyltransferase family 1 member A1 (UGT1A1) (e.g., Crigler Najjir), opioid receptor mu 1 (OPRM1) (e.g., borderline personality disorder), opioid receptor kappa 1 (OPRK1), opioid receptor delta 1 (OPRD1) (e.g., opiate addiction), solute carrier family 6 member 4 (SLC6A4), 5-hydroxytryptamine receptor 2A (HTR2a), tryptophan hydroxylase 2 (TPH2) (e.g., major depressive disorder), dopamine receptor D2 (DRD2), glutamate metabotropic receptor 3 (GRM3), glutamate ionotropic receptor NMDA type subunit 2A (GRIN2A), serine racemase (SRR) (e.g., type 2 diabetes), glutamate ionotropic receptor AMPA type subunit 1 (GRIA1), calcium voltage-gated channel subunit alpha1 C (CACNA1C), calcium voltage-gated channel auxiliary subunit beta 2 (CACNB2), calcium voltage-gated channel subunit alpha1 I (CACN1I), glutamate decarboxylase 1 (GAD1), reelin (RELN), brain-derived neurotrophic factor (BDNF), tet methylcytosine dioxygenase 1 (TET1), dystrobrevin binding protein 1 (DTNBP1) (e.g., schizophrenia), ankyrin 3 (ANK3), teneurin transmembrane protein 4 (TENM4), tetratricopeptide repeat and ankyrin repeat containing 1 (TRANKI), adenylate cyclase 2 (ADCY2), calcium voltage-gated channel subunit alpha1 C (CACNA1C), brain derived neurotrophic factor (BDNF) (e.g., bipolar disorder), PR/SET domain 16 (PRDM16), adherens junctions associated protein 1 (AJAP1), myocyte enhancer factor 2D (MEF2D), transient receptor potential cation channel subfamily M member 8 (TRPM8), transforming growth factor beta receptor 2 (TGFBR2), phosphatase and actin regulator 1 (PHACTRI), succinyl-CoA:glutarate-CoA transferase (GA3), matrix metallopeptidase 16 (MMP16), astrotactin 2 (ASTN2), tetraspanin 2 (TSPAN2), glial cell line-derived neurotrophic factor family receptor alpha 2 (GFRA2), LDL receptor related protein 1 (LRP1) (e.g., migraine), human leukocyte antigen class II histocompatibility—D related beta chain 1 (HLA-DRB1), interleukin 7 receptor alpha (IL7Ra), interleukin 2 receptor alpha (IL2Ra), cytochrome P450 family 27 subfamily B member 1 (CYP27B1), tyrosine kinase 2 (TYK2) (e.g., multiple sclerosis), neurexin 1 (NRXN1), arylacetamide deacetylase (AADAC), catenin alpha 3 (CTNNA3), fibrous sheath CABYR binding protein (FSCB), regulator of calcineurin 1 (RCAN1) (e.g., Tourette syndrome), calmodulin regulated spectrin associated protein 1 (CAMSAP1LK1), NMDA receptor subunit 1, GAMA-A receptor subunit alpha-1, glutamate decarboxylase 2 (GAD65), adenosine kinase, germ cell nuclear factor (GCNF), brain-derived neurotrophic factor (BDNF), insulin-like growth factor (IGF), neuropeptide Y, galanin (e.g., epilepsy).

In some embodiments, a target gene encodes p2-microglobulin (B2M), BCL11A, KLF1, chemokine receptors (e.g., CCR5, CXCR4), miRNA (e.g., miR126), PDL1, CTLA4, or Collagen, type I, alpha 1 (COL1A1). In some embodiments, a target gene is a globin gene. In some embodiments, a target gene is a TCR gene. In some embodiments, a target gene is HBB, a HBA, hMSH2, HMLHI, growth factors GM-SCF, VEGF, EPO, ErbB2, or hGH.

For additional non-limiting examples of target genes, see, e.g., U.S. Pat. No. 9,970,001, U.S. patent application Ser. No. 15/521,294 (US20190032049) and Ser. No. 16/177,403 (US20190153476, e.g., Tables A-C), the entire contents of which are incorporated herein by reference.

In some embodiments, a target sequence is within about 3,000 base pairs flanking a CpG island, for example, within about: 2,900, 2,800, 2,700, 2,600, 2,500, 2,400, 2,300, 2,200, 2,100, 2,000, 1,900, 1850, 1,800, 1750, 1,700, 1,650, 1,600, 1,550, 1,500, 1,450, 1,400, 1,350, 1,300, 1,250, 1,200, 1,150, 1,100, 1,050, 1,000, 950, 900, 850, 800, 750, 700, 650, 600, 550, 500, 450, 400, 350, 300, 250, 200, 150, 100, 90, 80, 70, 60 or 50, base pairs flanking a CpG island. In some embodiments, a target sequence is within about 3,000 base pairs downstream of a CpG island, for example, within about: 2,900, 2,800, 2,700, 2,600, 2,500, 2,400, 2,300, 2,200, 2,100, 2,000, 1,900, 1850, 1,800, 1750, 1,700, 1,650, 1,600, 1,550, 1,500, 1,450, 1,400, 1,350, 1,300, 1,250, 1,200, 1,150, 1,100, 1,050, 1,000, 950, 900, 850, 800, 750, 700, 650, 600, 550, 500, 450, 400, 350, 300, 250, 200, 150, 100, 90, 80, 70, 60 or 50, base pairs downstream of a CpG island. In some embodiments, a target sequence is within about 3,000 base pairs upstream of a CpG island, for example, within about: 2,900, 2,800, 2,700, 2,600, 2,500, 2,400, 2,300, 2,200, 2,100, 2,000, 1,900, 1850, 1,800, 1750, 1,700, 1,650, 1,600, 1,550, 1,500, 1,450, 1,400, 1,350, 1,300, 1,250, 1,200, 1,150, 1,100, 1,050, 1,000, 950, 900, 850, 800, 750, 700, 650, 600, 550, 500, 450, 400, 350, 300, 250, 200, 150, 100, 90, 80, 70, 60 or 50, base pairs upstream of a CpG island.

In some embodiments, a target sequence is within about 2,500 base pairs flanking a CpG island. In some embodiments, a target sequence is within about 2,500 base pairs downstream of a CpG island. In some embodiments, a target sequence is within about 2,500 base pairs upstream of a CpG island.

In some embodiments, a target sequence is within about 2,000 base pairs flanking a CpG island. In some embodiments, a target sequence is within about 2,000 base pairs downstream of a CpG island. In some embodiments, a target sequence is within about 2,000 base pairs upstream of a CpG island.

In some embodiments, a target sequence is within about 1,500 base pairs flanking a CpG island. In some embodiments, a target sequence is within about 1,500 base pairs downstream of a CpG island. In some embodiments, a target sequence is within about 1,500 base pairs upstream of a CpG island.

In some embodiments, a target sequence is within about 1,000 base pairs flanking a CpG island. In some embodiments, a target sequence is within about 1,000 base pairs downstream of a CpG island. In some embodiments, a target sequence is within about 1,000 base pairs upstream of a CpG island.

In some embodiments, a target sequence is within about 500 base pairs flanking a CpG island. In some embodiments, a target sequence is within about 500 base pairs downstream of a CpG island. In some embodiments, a target sequence is within about 500 base pairs upstream of a CpG island.

In some embodiments, a target sequence is within about 200 base pairs flanking a CpG island. In some embodiments, a target sequence is within about 200 base pairs downstream of a CpG island. In some embodiments, a target sequence is within about 200 base pairs upstream of a CpG island.

In some embodiments, a target sequence is within about 100 base pairs flanking a CpG island. In some embodiments, a target sequence is within about 100 base pairs downstream of a CpG island. In some embodiments, a target sequence is within about 100 base pairs upstream of a CpG island.

DNA-Binding Domains

The term "a DNA-binding domain" refers to a protein or fragment thereof (e.g., a structural motif) that binds double- and/or single-stranded DNA, either directly or indirectly (e.g., through an intermediary such as a guide-RNA). In some embodiments, a DNA-binding domain binds double-stranded DNA. In some embodiments, a DNA-binding domain binds single-stranded DNA. In some embodiments, a DNA-binding domain binds a specific DNA sequence (i.e., a target sequence). In some embodiments, a DNA-binding domain has a general affinity to DNA. In some embodiments, a DNA-binding domain (e.g., a zinc finger or a transcription activator-like effector domain) binds DNA (e.g., a target sequence) directly. In some embodiments, a DNA-binding domain binds DNA (e.g., a target sequence) indirectly (e.g., via a guide RNA sequence).

In some embodiments, a DNA-binding domain comprises a DNA-binding domain of a nuclease (e.g., an endonuclease), for example, a clustered regularly interspaced short palindromic repeats (CRISPR)-associated protein (Cas), a transcription activator-like effector nuclease (TALEN), a zinc finger nuclease (ZFN), a meganuclease, a homing (HO) endonuclease, a transposon-encoded RNA-guided nuclease (e.g., isrB, iscB, or tnpB), or a eukaryotic programmable RNA-guided endonuclease (e.g., FANZOR), or any combination of the foregoing. In some embodiments, a DNA-binding domain comprises a DNA-binding domain of a nuclease (e.g., an endonuclease), for example, a clustered regularly interspaced short palindromic repeats (CRISPR)-associated protein (Cas), a transcription activator-like effector nuclease (TALEN), a zinc finger nuclease (ZFN), a meganuclease, a homing (HO) endonuclease, or a transposon-encoded RNA-guided nuclease (e.g., isrB, iscB, or tnpB), or any combination of the foregoing. In some embodiments, a nuclease (e.g., an endonuclease) lacks nuclease activity (e.g., is nuclease-deficient).

In some embodiments, a DNA-binding domain comprises a DNA-binding domain of an RNA-guided nuclease (e.g., endonuclease), for example, a Cas (e.g., of the Type I, Type II, Type III, Type IV, or Type V CRISPR-Cas system), a small Cas effector (e.g., CasX, CasMINI, or CasΦ), Fanzor (a eukaryotic programmable RNA-guided endonuclease), or a transposon-encoded RNA-guided nuclease (e.g., isrB, iscB, or tnpB), or any combination of the foregoing. In some embodiments, an RNA-guided nuclease (e.g., endonuclease) is nuclease-deficient (e.g., lacks nuclease activity). For additional information on Fanzor, see, e.g., Saito et al., Fanzor is a eukaryotic programmable RNA-guided endonuclease. Nature 620(7974):660-68 (2023), the entire contents of which are incorporated herein by reference.

In some embodiments, a DNA-binding domain comprises a DNA-binding domain of a nuclease-deficient RNA-guided DNA endonuclease enzyme. The term "nuclease-deficient RNA-guided DNA endonuclease enzyme" refers to an RNA-guided DNA endonuclease (e.g., a variant of a naturally occurring RNA-guided DNA endonuclease) that is capable of targeting a specific phosphodiester bond within a DNA polynucleotide when complexed with a separate polynucleotide sequence (e.g., a single guide RNA (sgRNA)), but is incapable of cleaving said phosphodiester bond to a significant degree under physiological conditions.

In some embodiments, a DNA-binding domain comprises a Cas, a ZFP or a TALE.

In some embodiments, a DNA-binding domain comprises a Cas. In some embodiments, a DNA-binding domain (e.g., of a nuclease-deficient RNA-guided DNA endonuclease enzyme) comprises a Cas of the Type II-A CRISPR-Cas system (e.g., Cas9).

In some embodiments, a DNA-binding domain comprises a nuclease-deficient Cas9 (dCas9), for example, from any one of the following species: *Streptococcus pyogenes, Streptococcus thermophilus, Streptococcus* sp., *Staphylococcus aureus, Listeria innocua, Lactobacillus gasseri, Francisella novicida, Wolinella succinogenes, Sutterella wadsworthensis,* Gammaproteobacteria, *Neisseria meningitidis, Campylobacter jejuni, Pasteurella multocida, Fibrobacter succinogenes, Rhodospirillum rubrum, Nocardiopsis dassonvillei, Streptomyces pristinaespiralis, Streptomyces viridochromogenes, Streptosporangium roseum, Alicyclobacillus acidocaldarius, Bacillus pseudomycoides, Bacillus selenitireducens, Exiguobacterium sibiricum, Lactobacillus delbrueckii, Lactobacillus salivarius, Lactobacillus buchneri, Treponema denticola, Microscilla marina,* Burkholderiales, *Polaromonas naphthalenivorans, Polaromonas* sp., *Crocosphaera watsonii,* Cyanothece sp., *Microcystis aeruginosa, Synechococcus* sp., *Acetohalobium arabaticum, Ammonifex degensii, Caldicellulosiruptor bescii,* Candidatus Desulforudis audaxviator, *Clostridium botulinum, Clostridium difficile, Finegoldia magna, Natranaerobius thermophilus, Pelotomaculum thermopropionicum, Acidithiobacillus caldus, Acidithiobacillus ferrooxidans, Allochromatium vinosum, Marinobacter* sp., *Nitrosococcus halophi-* lus, *Nitrosococcus watsonii*, *Pseudoalteromonas haloplanktis*, *Ktedonobacter racemifer*, *Methanohalobium evestigatum*, *Anabaena variabilis*, *Nodularia spumigena*, *Nostoc* sp., *Arthrospira maxima*, *Arthrospira platensis*, *Arthrospira* sp., *Lyngbya* sp., *Microcoleus chthonoplastes*, *Oscillatoria* sp., *Petrotoga mobilis*, *Thermosipho africanus*, *Streptococcus pasteurianus*, *Neisseria cinerea*, *Campylobacter lari*, *Parvibaculum lavamentivorans*, *Corynebacterium diphtheria*, and *Acaryochloris marina*, or a variant thereof.

In some embodiments, a DNA-binding domain comprises a *Staphylococcus aureus* dCas9, a *Streptococcus pyogenes* dCas9, a *S. aureus* dCas9, a dCas12a, or a dCas12f. In some embodiments, a DNA-binding domain comprises a *Staphylococcus aureus* dCas9. In some embodiments, a DNA-binding domain comprises a *Streptococcus pyogenes* dCas9. In some embodiments, a DNA-binding domain comprises a *S. aureus* dCas9. In some embodiments, a DNA-binding domain comprises a dCas12a. In some embodiments, a DNA-binding domain comprises a dCas12f.

In some embodiments, a DNA-binding domain comprises an amino acid sequence having at least about 80% sequence identity to a *Streptococcus pyogenes* dCas9 (e.g., SEQ ID NO:1), for example, having at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to *Streptococcus pyogenes* dCas9 (e.g., SEQ ID NO:1). In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to *Streptococcus pyogenes* dCas9 (e.g., SEQ ID NO:1). In some embodiments, a DNA-binding domain comprises an amino acid sequence having 100% sequence identity to the entire *Streptococcus pyogenes* dCas9 (e.g., SEQ ID NO:1).

In some embodiments, a DNA-binding domain comprises a *S. aureus* dCas9.

In some embodiments, a DNA-binding domain comprises an amino acid sequence having at least about 80% sequence identity to *S. aureus* dCas9 (e.g., SEQ ID NO:489), for example, having at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to *S. aureus* dCas9 (e.g., SEQ ID NO:489). In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to *S. aureus* dCas9 (e.g., SEQ ID NO:489). In some embodiments, a DNA-binding domain comprises an amino acid sequence having 100% sequence identity to the entire *S. aureus* dCas9 (e.g., SEQ ID NO:489).

In some embodiments, a DNA-binding domain (e.g., of a nuclease-deficient RNA-guided DNA endonuclease enzyme) comprises a Cas of the Type V-A CRISPR-Cas system (e.g., Cpf1, also referred to as Cas12a). In some embodiments, a Cas12a is AsCas12a (from Acidaminococcus sp.). In some embodiments, a Cas12a is Lb2Cas12a (from Lachnospiraceae sp.). In some embodiments, a DNA-binding domain comprises a nuclease-deficient Cpf1 (e.g., dCas12a, dCpf1 or ddCpf1).

In some embodiments, a DNA-binding domain (e.g., of a nuclease-deficient RNA-guided DNA endonuclease enzyme) comprises dCas12f. For additional information on dCas12f, see, e.g., Hino et al., An AsCas12f-based compact genome-editing tool derived by deep mutational scanning and structural analysis, Cell 186(22):4920-35 (2023), the entire contents of which are incorporated herein by reference.

In some embodiments, a DNA-binding domain comprises CRISPR-Cas protein bound to (i.e., complexed with) a guide polynucleotide. In some embodiments, a guide polynucleotide hybridizes with a target sequence (e.g., a genomic target sequence).

For additional information on CRISPR-Cas proteins, see, e.g., PCT application Nos. PCT/US2021/064913 (WO 2022/140577) and PCT/US2021/035244 (WO 2021/247570), the entire contents of which are incorporated herein by reference.

In some embodiments, a DNA-binding domain comprises a DNA-binding domain of a zinc finger protein (ZFP). Non-limiting examples of ZFPs and DNA-binding domains thereof include those disclosed in U.S. Pat. No. 7,534,775, the entire contents of which are incorporated herein by reference. Also see, e.g., SEQ ID NOs:3-15 for non-limiting examples of ZFP sequences targeting CD55 or PRNP transcription start site.

In some embodiments, a ZFP DNA-binding domain comprises an amino acid sequence having at least about 80% sequence identity to at least one sequence set forth in SEQ ID NOs:3-15, for example, having at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to at least one sequence set forth in SEQ ID NOs:3-15. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to at least one sequence set forth in SEQ ID NOs:3-15. In some embodiments, a ZFP DNA-binding domain comprises an amino acid sequence having 100% sequence identity to a sequence set forth in SEQ ID NOs:3-15.

In some embodiments, a DNA-binding domain comprises a DNA-binding domain of a TALEN (e.g., a TALEN DNA-binding domain such as TALE).

In some embodiments, a TALE DNA-binding domain comprises an amino acid sequence having at least about 80% sequence identity to at least one sequence (e.g., at least two, at least three, at least four, at least five, at least six, at least seven, or all eight sequences) set forth in SEQ ID NOs:454-461, for example, having at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to at least one sequence set forth in SEQ ID NOs:454-461. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to at least one sequence set forth in SEQ ID NOs:454-461. In some embodiments, a TALE DNA-binding domain comprises an amino acid sequence having 100% sequence identity to a sequence set forth in SEQ ID NOs:454-461.

In some embodiments, a TALE DNA-binding domain comprises an amino acid sequence having at least about 80% sequence identity to at least one sequence (e.g., at least two, at least three, at least four, at least five, at least six, at least seven, or all eight sequences) set forth in SEQ ID NOs:462-469, for example, having at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to at least one sequence set forth in SEQ ID NOs:462-469. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to at least one sequence set forth in SEQ ID NOs:462-469. In some embodiments, a TALE DNA-binding domain comprises an amino acid sequence having 100% sequence identity to a sequence set forth in SEQ ID NOs:462-469.

In some embodiments, a TALE DNA-binding domain comprises an amino acid sequence having at least about 80% sequence identity to SEQ ID NO:454, for example, having at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to SEQ ID NO:454. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to SEQ ID NO:454. In some embodiments, a TALE DNA-binding domain comprises an amino acid sequence having 100% sequence identity to SEQ ID NO:454.

In some embodiments, a TALE DNA-binding domain comprises an amino acid sequence having at least about 80% sequence identity to SEQ ID NO:455, for example, having at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to SEQ ID NO:455. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to SEQ ID NO:455. In some embodiments, a TALE DNA-binding domain comprises an amino acid sequence having 100% sequence identity to SEQ ID NO:455.

In some embodiments, a TALE DNA-binding domain comprises an amino acid sequence having at least about 80% sequence identity to SEQ ID NO:456, for example, having at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to SEQ ID NO:456. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to SEQ ID NO:456. In some embodiments, a TALE DNA-binding domain comprises an amino acid sequence having 100% sequence identity to SEQ ID NO:456.

In some embodiments, a TALE DNA-binding domain comprises an amino acid sequence having at least about 80% sequence identity to SEQ ID NO:457, for example, having at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to SEQ ID NO:457. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to SEQ ID NO:457. In some embodiments, a TALE DNA-binding domain comprises an amino acid sequence having 100% sequence identity to SEQ ID NO:457.

In some embodiments, a TALE DNA-binding domain comprises an amino acid sequence having at least about 80% sequence identity to SEQ ID NO:458, for example, having at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to SEQ ID NO:458. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to SEQ ID NO:458. In some embodiments, a TALE DNA-binding domain comprises an amino acid sequence having 100% sequence identity to SEQ ID NO:458.

In some embodiments, a TALE DNA-binding domain comprises an amino acid sequence having at least about 80% sequence identity to SEQ ID NO:459, for example, having at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to SEQ ID NO:459. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to SEQ ID NO:459. In some embodiments, a TALE DNA-binding domain comprises an amino acid sequence having 100% sequence identity to SEQ ID NO:459.

In some embodiments, a TALE DNA-binding domain comprises an amino acid sequence having at least about 80% sequence identity to SEQ ID NO:460, for example, having at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to SEQ ID NO:460. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to SEQ ID NO:460. In some embodiments, a TALE DNA-binding domain comprises an amino acid sequence having 100% sequence identity to SEQ ID NO:460.

In some embodiments, a TALE DNA-binding domain comprises an amino acid sequence having at least about 80% sequence identity to SEQ ID NO:461, for example, having at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to SEQ ID NO:461. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to SEQ ID NO:461. In some embodiments, a TALE DNA-binding domain comprises an amino acid sequence having 100% sequence identity to SEQ ID NO:461.

In some embodiments, a TALE DNA-binding domain comprises an amino acid sequence having at least about 80% sequence identity to SEQ ID NO:462, for example, having at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to SEQ ID NO:462. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to SEQ ID NO:462. In some embodiments, a TALE DNA-binding domain comprises an amino acid sequence having 100% sequence identity to SEQ ID NO:462.

In some embodiments, a TALE DNA-binding domain comprises an amino acid sequence having at least about 80% sequence identity to SEQ ID NO:463, for example, having at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to SEQ ID NO:463. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to SEQ ID NO:463. In some embodiments, a TALE DNA-binding domain comprises an amino acid sequence having 100% sequence identity to SEQ ID NO:463.

In some embodiments, a TALE DNA-binding domain comprises an amino acid sequence having at least about 80% sequence identity to SEQ ID NO:464, for example, having at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to SEQ ID NO:464. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to SEQ ID NO:464. In some embodiments, a TALE DNA-binding domain comprises an amino acid sequence having 100% sequence identity to SEQ ID NO:464.

In some embodiments, a TALE DNA-binding domain comprises an amino acid sequence having at least about 80% sequence identity to SEQ ID NO:465, for example, having at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to SEQ ID NO:465. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to SEQ ID NO:465. In some embodiments, a TALE DNA-binding domain comprises an amino acid sequence having 100% sequence identity to SEQ ID NO:465.

In some embodiments, a TALE DNA-binding domain comprises an amino acid sequence having at least about 80% sequence identity to SEQ ID NO:466, for example, having at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to SEQ ID NO:466. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to SEQ ID NO:466. In some embodiments, a TALE DNA-binding domain comprises an amino acid sequence having 100% sequence identity to SEQ ID NO:466.

In some embodiments, a TALE DNA-binding domain comprises an amino acid sequence having at least about 80% sequence identity to SEQ ID NO:467, for example, having at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to SEQ ID NO:467. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to SEQ ID NO:467. In some embodiments, a TALE DNA-binding domain comprises an amino acid sequence having 100% sequence identity to SEQ ID NO:467.

In some embodiments, a TALE DNA-binding domain comprises an amino acid sequence having at least about 80% sequence identity to SEQ ID NO:468, for example, having at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to SEQ ID NO:468. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to SEQ ID NO:468. In some embodiments, a TALE DNA-binding domain comprises an amino acid sequence having 100% sequence identity to SEQ ID NO:468.

In some embodiments, a TALE DNA-binding domain comprises an amino acid sequence having at least about 80% sequence identity to SEQ ID NO:469, for example, having at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to SEQ ID NO:469. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to SEQ ID NO:469. In some embodiments, a TALE DNA-binding domain comprises an amino acid sequence having 100% sequence identity to SEQ ID NO:469.

In some embodiments, a DNA-binding domain comprises a DNA-binding domain of a ZFN (e.g., a nuclease-deficient ZFN such as a ZFP). Non-limiting examples of TALEN, ZFN and DNA-binding domains thereof include those disclosed in Patent Cooperation Treaty (PCT) Application Publication No. WO2016063264, and Gaj et al., ZFN, TALEN, and CRISPRICas-based methods for genome engineering, Trends Biotechnol. 31(7):397-405 (2013), the entire contents of which are incorporated herein by reference.

In some embodiments, a DNA-binding domain comprises a DNA-binding domain of a meganuclease (e.g., a nuclease-deficient meganuclease). See, e.g., Silva et al., *Meganucleases and other tools for targeted genome engineering: perspectives and challenges for gene therapy*, Curr Gene Ther. 11(1):11-27 (2011), the entire contents of which are incorporated herein by reference.

In some embodiments, a DNA-binding domain comprises a DNA-binding domain of a transcription regulator (e.g., a tetracycline-controlled repressor (tetR)). In some embodiments, a DNA-binding domain comprises a leucine zipper domain, a winged helix domain, a helix-turn-helix domain, a helix-loop-helix domain, a chromatin-associated high-mobility group (HMG)-box domain, a white-opaque regulator 3 (Wor3) domain, an oligonucleotide/oligosaccharide-binding (OB)-fold domain, an immunoglobulin domain, or a B3 DNA-binding domain.

In some embodiments, a DNA-binding domain is selected and/or engineered to bind to a desired DNA sequence (e.g., a target DNA sequence, for example, in genomic DNA).

DNMT3 Methyltransferase-Binding Domains

The term "a DNMT3 methyltransferase-binding domain" refers to a protein or fragment thereof that binds, directly or indirectly (e.g., through an intermediary), to a DNMT3 methyltransferase.

In some embodiments, a DNMT3 methyltransferase-binding domain binds a DNMT3A (e.g., a human DNMT3A), a DNMT3B (e.g., a human DNMT3B), or a DNMT3C (e.g., a mouse DNMT3C), or any combination thereof. In some embodiments, a DNMT3 methyltransferase-binding domain binds a DNMT3A, or a DNMT3B, or both. In some embodiments, a DNMT3 methyltransferase-binding domain binds a DNMT3A.

In some embodiments, a DNMT3 methyltransferase-binding domain binds a catalytic domain of a DNMT3 methyltransferase (e.g., a human DNMT3 methyltransferase). In some embodiments, a DNMT3 methyltransferase-binding domain binds a catalytic domain of a human DNMT3A (e.g., comprising SEQ ID NO:29).

In some embodiments, a DNMT3 methyltransferase-binding domain is less than or equal to about 300 amino acids in length, for example, less than or equal to about: 290, 280, 270, 260, 250, 240, 230, 220, 215, 210, 205, or 200 amino acids in length. In some embodiments, a DNMT3 methyltransferase-binding domain is about 200-220 amino acids in length.

In some embodiments, a DNMT3 methyltransferase-binding domain comprises a DNA methyltransferase 3-like protein (Dnmt3L) or a fragment thereof. In some embodiments, a DNMT3 methyltransferase-binding domain comprises a Dnmt3L C-terminal domain.

In some embodiments, a Dnmt3L C-terminal domain is a human, monkey, boar, mouse, rat, hamster, wood mouse, groundhog, jerboa, vole, lemur, chinchilla, bear, camel, donkey, sloth, pangolin, pika, fox, wombat, ancestral alpha, ancestral beta, ancestral delta, ancestral epsilon, or ancestral gamma DNMT3L C-terminal domain.

In some embodiments, a Dnmt3L C-terminal domain is a rodent (e.g., mouse, rat, hamster, wood mouse, chinchilla, groundhog, jerboa, or vole) DNMT3L C-terminal domain. In some embodiments, a Dnmt3L C-terminal domain is a mouse (*Mus musculus*) DNMT3L C-terminal domain or a wood mouse (*Apodemus sylvaticus*) DNMT3L C-terminal domain. In some embodiments, a Dnmt3L C-terminal domain is a mouse (*Mus musculus*) DNMT3L C-terminal domain. In some embodiments, a Dnmt3L C-terminal domain is a wood mouse (*Apodemus sylvaticus*) DNMT3L C-terminal domain.

In some embodiments, a Dnmt3L C-terminal domain is a human DNMT3L C-terminal domain.

In some embodiments, a Dnmt3L C-terminal domain comprises an amino acid sequence having at least about 80% sequence identity to at least one sequence set forth in SEQ ID NOs:31-50 and 71-75, for example, having at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to at least one sequence set forth in SEQ ID NOs:31-50 and 71-75. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to at least one sequence set forth in SEQ ID NOs:31-50 and 71-75. In some embodiments, a Dnmt3L C-terminal domain comprises an amino acid sequence having 100% sequence identity to a sequence set forth in SEQ ID NOs:31-50 and 71-75.

In some embodiments, a Dnmt3L C-terminal domain comprises an amino acid sequence having at least about 80% sequence identity to at least one sequence set forth in SEQ ID NOs:31-50, for example, having at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to at least one sequence set forth in SEQ ID NOs:31-50. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to at least one sequence set forth in SEQ ID NOs:31-50. In some embodiments, a Dnmt3L C-terminal domain comprises an amino acid sequence having 100% sequence identity to a sequence set forth in SEQ ID NOs: 31-50.

In some embodiments, a Dnmt3L C-terminal domain comprises an amino acid sequence having at least about 80% sequence identity to the sequence set forth in SEQ ID NO:31, for example, having at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to the sequence set forth in SEQ ID NO:31. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to the sequence set forth in SEQ ID NO:31. In some embodiments, a Dnmt3L C-terminal domain comprises an amino acid sequence having 100% sequence identity to the sequence set forth in SEQ ID NO:31.

In some embodiments, a Dnmt3L C-terminal domain comprises an amino acid sequence having at least about 80% sequence identity to the sequence set forth in SEQ ID NO:32, for example, having at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to the sequence set forth in SEQ ID NO:32. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to the sequence set forth in SEQ ID NO:32. In some embodiments, a Dnmt3L C-terminal domain comprises an amino acid sequence having 100% sequence identity to the sequence set forth in SEQ ID NO:32.

In some embodiments, a Dnmt3L C-terminal domain comprises an amino acid sequence having at least about 80% sequence identity to the sequence set forth in SEQ ID NO:38, for example, having at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to the sequence set forth in SEQ ID NO:38. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to the sequence set forth in SEQ ID NO:38. In some embodiments, a Dnmt3L C-terminal domain comprises an amino acid sequence having 100% sequence identity to the sequence set forth in SEQ ID NO:38.

In some embodiments, a Dnmt3L C-terminal domain comprises an amino acid sequence having at least about 80% sequence identity to at least one sequence set forth in SEQ ID NOs:71-75, for example, having at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to at least one sequence set forth in SEQ ID NOs:71-75. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to at least one sequence set forth in SEQ ID NOs:71-75. In some embodiments, a Dnmt3L C-terminal domain comprises an amino acid sequence having 100% sequence identity to a sequence set forth in SEQ ID NOs: 71-75.

In some embodiments, a DNMT3 methyltransferase-binding domain comprises a DNMT3 mutant. In some embodiments, a DNMT3 mutant lacks methyltransferase activity (e.g., is catalytically inactive). In some embodiments, a DNMT3 methyltransferase-binding domain comprises a catalytically inactive DNMT3 (e.g., a catalytically inactive human DNMT3). In some embodiments, a DNMT3 methyltransferase-binding domain comprises a catalytically inactive DNMT3A (e.g., a catalytically inactive human DNMT3A).

In some embodiments, a DNMT3 methyltransferase-binding domain recruits a DNMT3 methyltransferase (e.g., DNMT3A) to a genomic locus in a cell (e.g., a human cell). H3K4me0

As used herein, the term "H3K4me0" refers to a histone 3 (H3)N-terminal tail domain that comprises an unmethylated lysine (K) 4 residue and which binds an ADD domain.

In some embodiments, a H3K4me0 is human H3K4me0.

In some embodiments, a human H3 protein comprises the amino acid sequence of SEQ ID NO:393, SEQ ID NO:394, SEQ ID NO:395 or SEQ ID NO:396.

In some embodiments, a human H3 protein comprises an amino acid having at least about 80% sequence identity to the sequence set forth in SEQ ID NO:393, for example, has at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to the sequence set forth in SEQ ID NO:393. In some embodiments, a human H3 protein comprises an amino acid having about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to the sequence set forth in SEQ ID NO:393. In some embodiments, a human H3 protein comprises an amino acid having 100% sequence identity to the sequence set forth in SEQ ID NO:393. In some embodiments, H3K4me0 comprises an N-terminal fragment (e.g., a 12-aa or a 30-aa N-terminal fragment) of SEQ ID NO:393.

In some embodiments, a human H3 protein comprises an amino acid having at least about 80% sequence identity to the sequence set forth in SEQ ID NO:394, for example, has at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to the sequence set forth in SEQ ID NO:394. In some embodiments, a human H3 protein comprises an amino acid having about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to the sequence set forth in SEQ ID NO:394. In some embodiments, a human H3 protein comprises an amino acid having 100% sequence identity to the sequence set forth in SEQ ID NO:394. In some embodiments, H3K4me0 comprises an N-terminal fragment (e.g., a 12-aa or a 30-aa N-terminal fragment) of SEQ ID NO:394.

In some embodiments, a human H3 protein comprises an amino acid having at least about 80% sequence identity to the sequence set forth in SEQ ID NO:395, for example, has at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to the sequence set forth in SEQ ID NO:395. In some embodiments, a human H3 protein comprises an amino acid having about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to the sequence set forth in SEQ ID NO:395. In some embodiments, a human H3 protein comprises an amino acid having 100% sequence identity to the sequence set forth in SEQ ID NO:395. In some embodiments, H3K4me0 comprises an N-terminal fragment (e.g., a 12-aa or a 30-aa N-terminal fragment) of SEQ ID NO:395.

In some embodiments, a human H3 protein comprises an amino acid having at least about 80% sequence identity to the sequence set forth in SEQ ID NO:396, for example, has at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to the sequence set forth in SEQ ID NO:396. In some embodiments, a human H3 protein comprises an amino acid having about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to the sequence set forth in SEQ ID NO:396. In some embodiments, a human H3 protein comprises an amino acid having 100% sequence identity to the sequence set forth in SEQ ID NO:396. In some embodiments, H3K4me0 comprises an N-terminal fragment (e.g., a 12-aa or a 30-aa N-terminal fragment) of SEQ ID NO:396.

In some embodiments, H3K4me0 comprises an N-terminal fragment (e.g., a 12-aa or a 30-aa N-terminal fragment) of SEQ ID NO:393, SEQ ID NO:394, SEQ ID NO:395 or SEQ ID NO:396. In some embodiments, H3K4me0 comprises an N-terminal fragment (e.g., a 12-aa or a 30-aa N-terminal fragment) of SEQ ID NO:393.

In some embodiments, H3K4me0 is greater than or equal to 4 amino acids in length, for example, greater than or equal to 5, 6, 7, 8, 9, 10, 11, or 12 amino acids in length. In some embodiments, H3K4me0 is greater than or equal to 12 amino acids in length. In some embodiments, H3K4me0 is less than or equal to 57 amino acids in length, for example, less than or equal to 55, 52, 50, 48, 45, 42, 40, 38, 35, 34, 33, 32, 31, or 30 amino acids in length. In some embodiments, H3K4me0 is less than or equal to 30 amino acids in length. In some embodiments, H3K4me0 is about 4 to 57 amino acids in length, for example, about: 5-57, 5-55, 5-30, 6-55, 6-50, 6-30, 7-50, 7-45, 7-30, 8-45, 8-40, 8-30, 9-40, 9-35, 9-30, 10-35, 10-32, 10-30, 11-32, 11-30, 12-57, 12-55, 12-50, 12-45, 12-40, 12-35, 12-30, 20-40, 21-39, 22-38, 23-37, 24-36, 25-35, 26-34, 27-33, 28-32, or 29-31 amino acids in length. In some embodiments, H3K4me0 is about 12 to 30 amino acids in length. In some embodiments, H3K4me0 is about 28 to 32 amino acids in length.

In some embodiments, a H3K4me0 is about 12 amino acids in length.

In some embodiments, a H3K4me0 comprises an amino acid having at least about 80% sequence identity to the sequence set forth in SEQ ID NO:81, for example, has at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to the sequence set forth in SEQ ID NO:81. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to the sequence set forth in SEQ ID NO:81. In some embodiments, a H3K4me0 comprises an amino acid having 100% sequence identity to the sequence set forth in SEQ ID NO:81.

In some embodiments, a H3K4me0 is about 30 amino acids in length.

In some embodiments, a H3K4me0 comprises an amino acid having at least about 80% sequence identity to the sequence set forth in SEQ ID NO:87, for example, has at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to the sequence set forth in SEQ ID NO:87. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to the sequence set forth in SEQ ID NO:87. In some embodiments, a H3K4me0 comprises an amino acid having 100% sequence identity to the sequence set forth in SEQ ID NO:87.

In some embodiments, a H3K4me0 comprises an amino acid having at least about 80% sequence identity to at least one sequence set forth in SEQ ID NOs:81 and 87, for example, has at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to at least one sequence set forth in SEQ ID NOs:81 and 87. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to at least one sequence set forth in SEQ ID NOs:81 and 87. In some embodiments, a H3K4me0 comprises an amino acid having 100% sequence identity to a sequence set forth in SEQ ID NOs:81 and 87.

Linkers

In some embodiments, a fusion protein disclosed herein comprises a linker connecting two domains (e.g., a DNMT3 methyltransferase-binding domain with a H3K4me0, a DNMT3 methyltransferase-binding domain with a DNA-binding domain with, or a H3K4me0 with a DNA-binding domain). In some embodiments, a linker connects a DNMT3 methyltransferase-binding domain with a H3K4me0. In some embodiments, a linker connects a DNMT3 methyltransferase-binding domain with a DNA-binding domain. In some embodiments, a linker connects a H3K4me0 with a DNA-binding domain.

In some embodiments, a linker increases flexibility, is proteolysis resistant, or is self-cleaving, or any combination thereof.

In some embodiments, a linker comprises about 15 to 100 amino acids, for example, comprises about: 16, 18, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, or 100 amino acids. In some embodiments, a linker comprises about 16-80 amino acids, for example, comprises about: 16-75, 16-70, 16-65, 16-60, 16-55, 16-50, 16-45, 16-40, 16-35, 16-30, 16-25, 16-20, 20-80, 20-75, 20-70, 20-65, 20-60, 20-55, 20-50, 20-45, 20-40, 20-35, 20-30, 20-25, 25-80, 25-75, 25-70, 25-65, 25-60, 25-55, 25-50, 25-45, 25-40, 25-35, 25-30, 30-80, 30-75, 30-70, 30-65, 30-60, 30-55, 30-50, 30-45, 30-40, 30-35, 35-80, 35-75, 35-70, 35-65, 35-60, 35-55, 35-50, 35-45, 35-40, 40-75, 40-70, 40-65, 40-60, 40-55, 40-50, 40-45, 45-80, 45-75, 45-70, 45-65, 45-60, 45-55, 45-50, 50-80, 50-75, 50-70, 50-65, 50-60, 50-55, 55-80, 55-75, 55-70, 55-65, 55-60, 60-80, 60-75, 60-70, 60-65, 65-80, 65-75, 65-70, 70-80, 70-75, or 75-80 amino acids. In some embodiments, a linker comprises about: 35-45, 36-44, 37-43, 38-42 or 39-41 amino acids. In some embodiments, a linker comprises about 40 amino acids.

In some embodiments, a linker comprises an amino acid sequence having at least about 80% sequence identity to the amino acid sequence set forth in SEQ ID NO:89, for example, has at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to the sequence set forth in SEQ ID NO:89. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to the sequence set forth in SEQ ID NO:89. In some embodiments, a linker comprises an amino acid sequence having 100% sequence identity to the sequence set forth in SEQ ID NO:89.

In some embodiments, a linker comprises an amino acid sequence having at least about 80% sequence identity to the amino acid sequence set forth in SEQ ID NO:96, for example, has at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to the sequence set forth in SEQ ID NO:96. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to the sequence set forth in SEQ ID NO:96. In some embodiments, a linker comprises an amino acid sequence having 100% sequence identity to the sequence set forth in SEQ ID NO:96.

In some embodiments, a linker comprises an amino acid sequence having at least about 80% sequence identity to the amino acid sequence set forth in SEQ ID NO:506, for example, has at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to the sequence set forth in SEQ ID NO:506. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to the sequence set forth in SEQ ID NO:506. In some embodiments, a linker comprises an amino acid sequence having 100% sequence identity to the sequence set forth in SEQ ID NO:506.

In some embodiments, a linker increases flexibility of a fusion protein or one or more domains thereof.

In some embodiments, a linker is a glycine-serine linker or a variant thereof, for example, $(GGGGS)_n$, wherein n is 1, 2, 3, 4, 5, 6 or 7 or more, or a variant thereof.

In some embodiments, a linker comprises an amino acid sequence having at least about 80% sequence identity to at least one sequence set forth in SEQ ID NOs:89-100, for example, has at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to at least one sequence set forth in SEQ ID NOs:89-100. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to at least one sequence set forth in SEQ ID NOs:89-100. In some embodiments, a linker comprises an amino acid sequence having 100% sequence identity to a sequence set forth in SEQ ID NOs:89-100.

In some embodiments, a linker comprises an amino acid sequence having at least about 80% sequence identity to at least one sequence set forth in SEQ ID NOs:89-100 and 506, for example, has at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to at least one sequence set forth in SEQ ID NOs:89-100 and 506. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to at least one sequence set forth in SEQ ID NOs:89-100 and 506. In some embodiments, a linker comprises an amino acid sequence having 100% sequence identity to a sequence set forth in SEQ ID NOs:89-100 and 506.

In some embodiments, a linker comprises an amino acid sequence having at least about 80% sequence identity to the amino acid sequence set forth in SEQ ID NO:90, for example, has at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to the sequence set forth in SEQ ID NO:90. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to the sequence set forth in SEQ ID NO:90. In some embodiments, a linker comprises an amino acid sequence having 100% sequence identity to the sequence set forth in SEQ ID NO:90.

In some embodiments, a linker is proteolysis resistant. In some embodiments, a linker is a XTEN linker, for example, a XTEN16, XTEN24, XTEN32, XTEN34, XTEN36, XTEN38, XTEN40, XTEN42, XTEN44, XTEN46, XTEN48, XTEN50, XTEN52, XTEN54, or XTEN80 linker.

In some embodiments, a linker comprises an amino acid sequence having at least about 80% sequence identity to at least one sequence set forth in SEQ ID NOs:113-128 (e.g., SEQ ID NOs:113-127), for example, has at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to at least one sequence set forth in SEQ ID NOs:113-128 (e.g., SEQ ID NOs:113-127). In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to at least one sequence set forth in SEQ ID NOs:113-128 (e.g., SEQ ID NOs:113-127). In some embodiments, a linker comprises an amino acid sequence having 100% sequence identity to a sequence set forth in SEQ ID NOs:113-128 (e.g., SEQ ID NOs:113-127).

In some embodiments, a linker (e.g., XTEN) linker comprises a nuclear localization signal (NLS). In some embodiments, a linker comprises an amino acid sequence having at least about 80% sequence identity to the amino acid sequence set forth in SEQ ID NO:128, for example, has at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to the sequence set forth in SEQ ID NO:128. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to the sequence set forth in SEQ ID NO:128. In some embodiments, a linker comprises an amino acid sequence having 100% sequence identity to the sequence set forth in SEQ ID NO:128.

In some embodiments, a linker is a self-cleaving linker.

In some embodiments, a linker is a P2A self-cleaving linker. In some embodiments, a linker comprises an amino acid sequence having at least about 80% sequence identity to the amino acid sequence set forth in SEQ ID NO:145, for example, has at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to the sequence set forth in SEQ ID NO:145. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to the sequence set forth in SEQ ID NO:145. In some embodiments, a linker comprises an amino acid sequence having 100% sequence identity to the sequence set forth in SEQ ID NO:145.

In some embodiments, a linker is a T2A self-cleaving linker. In some embodiments, a linker comprises an amino acid sequence having at least about 80% sequence identity to the amino acid sequence set forth in SEQ ID NO:147, for example, has at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to the sequence set forth in SEQ ID NO:147. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to the sequence set forth in SEQ ID NO:147. In some embodiments, a linker comprises an amino acid sequence having 100% sequence identity to the sequence set forth in SEQ ID NO:147.

In some embodiments, a linker comprises an amino acid sequence having at least about 80% sequence identity to at least one sequence set forth in SEQ ID NOs:89-100, SEQ ID NOs:113-128, SEQ ID NO:145 and SEQ ID NO:147, for example, has at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to at least one sequence set forth in SEQ ID NOs:89-100, SEQ ID NOs:113-128, SEQ ID NO:145 and SEQ ID NO:147. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to at least one sequence set forth in SEQ ID NOs:89-100, SEQ ID NOs:113-128, SEQ ID NO:145 and SEQ ID NO:147. In some embodiments, a linker comprises an amino acid sequence having 100% sequence identity to a sequence set forth in SEQ ID NOs:89-100, SEQ ID NOs:113-128, SEQ ID NO:145 and SEQ ID NO:147.

In some embodiments, a linker comprises an amino acid sequence having at least about 80% sequence identity to at least one sequence set forth in SEQ ID NOs:96, 100 and 119, for example, has at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to at least one sequence set forth in SEQ ID NOs:96, 100 and 119. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to at least one sequence set forth in SEQ ID NOs:96, 100 and 119. In some embodiments, a linker comprises an amino acid sequence having 100% sequence identity to a sequence set forth in SEQ ID NOs:96, 100 and 119.

Domains that Recruit Histone Methyltransferases

In some embodiments, a fusion protein further comprises a domain that recruits a histone methyltransferase.

In some embodiments, a domain that recruits a histone methyltransferase comprises a Krüppel-associated box (KRAB) domain or a homologue thereof. In some embodiments, a domain that recruits a histone methyltransferase comprises a human Krüppel-associated box (KRAB) domain or a variant thereof.

In some embodiments, a KRAB domain is a KRAB domain of a human KRAB-ZFP or a homologue thereof. Non-limiting examples of human KRAB-ZFPs include FPM315, HKr18, HKr19, HZF4, HZF12, KID-1, KOX1, RbaK, RITA, ZBRK1, ZF5128, ZFP1, ZFP14, ZFP28-1, ZFP28-2, ZFP82, Zfp93, ZFP95, ZIM2, ZIM, ZK1, ZNF18, ZNF30, ZNF33A, ZNF34, ZNF41, ZNF43, ZNF45, ZNF75D, ZNF85, ZNF91, ZNF98, ZNF133, ZNF136, ZNF140, ZNF141, ZNF155, ZNF157, ZNF175, ZNF184, ZNF189, ZNF197, ZNF202, ZNF213, ZNF214, ZNF224, ZNF221, ZNF222, ZNF224, ZNF225, ZNF226, ZNF250, ZNF254, ZNF257, ZNF264, ZNF273, ZNF274, ZNF282, ZNF320, ZNF324, ZNF331, ZNF350, ZNF354A, ZNF37A, ZNF394, ZNF398, ZNF416, ZNF419, ZNF436, ZNF490, ZNF528, ZNF543, ZNF547, ZNF554, ZNF557, ZNF566, ZNF582, ZNF595, ZNF596, ZNF610, ZNF669, ZNF675, ZNF677, ZNF680, ZNF729, ZNF764, ZNF785, ZNF8, and ZNF816. For additional information on human KRAB-ZFPs, see, e.g., Ecco et al., *KRAB zinc finger proteins*, Development 144(15):2719-29 (2017); Lupo et al., *KRAB-Zinc Finger Proteins: A Repressor Family Displaying Multiple Biological Functions*, Curr Genomics 14(4):268-78 (2013); Urrutia, KRAB-containing zinc-finger repressor proteins, Genome Biol. 4(10):231 (2003); and Alerasool et al., *An efficient KRAB domain for CRISPRi applications in human cells*, Nat Methods 17(11):1093-96 (2020), the entire contents of which are incorporated herein by reference.

In some embodiments, a KRAB domain is a KOX1 KRAB domain. In some embodiments, a KRAB domain is a ZIM3 KRAB domain.

In some embodiments, a KRAB domain comprises an amino acid sequence having at least about 80% sequence identity to the amino acid sequence set forth in SEQ ID NO:155, for example, has at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to the sequence set forth in SEQ ID NO:155. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to the sequence set forth in SEQ ID NO:155. In some embodiments, a KRAB domain comprises an amino acid sequence having 100% sequence identity to the sequence set forth in SEQ ID NO:155.

In some embodiments, a fusion protein does not include any domain that recruits a histone methyltransferase. In some embodiments, a fusion protein lacks does not include any KRAB domain.

Histone Methyltransferases

In some embodiments, a fusion protein further comprises a histone methyltransferase or a homologue thereof. In some embodiments, a histone methyltransferase comprises an enhancer of zeste homolog 2 (EZH2) protein or a fragment thereof (e.g., having histone methyltransferase catalytic activity). In some embodiments, a histone methyltransferase comprises human EZH2 (see, e.g., Grzenda et al., *Functional characterization of EZH2β reveals the increased complexity of EZH2 isoforms involved in the regulation of mammalian gene expression*, Epigenetics Chromatin 6(1):3 (2013)). In some embodiments, a histone methyltransferase comprises human EZH2 isoform a (see, e.g., NCBI Reference Sequence: NP_004447.2).

Nuclear Localization Signal (NLS)

In some embodiments, a fusion protein disclosed herein further comprises a nuclear localization signal (NLS).

In some embodiments, an NLS is a bipartite NLS. In some embodiments, a bipartite NLS comprises an amino acid sequence having at least about 80% sequence identity to the amino acid sequence set forth in SEQ ID NO:149, for example, has at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to the sequence set forth in SEQ ID NO:149. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to the sequence set forth in SEQ ID NO:149. In some embodiments, a bipartite NLS comprises an amino acid sequence having 100% sequence identity to the sequence set forth in SEQ ID NO:149.

In some embodiments, an NLS is a SV40 NLS. In some embodiments, a SV40 NLS comprises an amino acid sequence having at least about 80% sequence identity to the amino acid sequence set forth in SEQ ID NO:151, for example, has at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to the sequence set forth in SEQ ID NO:151. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to the sequence set forth in SEQ ID NO:151. In some embodiments, a SV40 NLS comprises an amino acid sequence having 100% sequence identity to the sequence set forth in SEQ ID NO:151.

In some embodiments, a NLS comprises an amino acid sequence having at least about 80% sequence identity to the amino acid sequence set forth in SEQ ID NO:149 or SEQ ID NO:151, for example, has at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to the sequence set forth in SEQ ID NO:149 or SEQ ID NO:151. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to the sequence set forth in SEQ ID NO:149 or SEQ ID NO:151. In some embodiments, a NLS comprises an amino acid sequence having 100% sequence identity to the sequence set forth in SEQ ID NO:149 or SEQ ID NO:151.

In some embodiments, a polynucleotide further comprises a nucleotide sequence encoding a switchable nuclear-localization sequence. In some embodiments, a switchable nuclear-localization sequence allows precise, user-defined control, e.g., temporal control, of nuclear-localization. For additional information on switchable nuclear-localization, see, e.g., Niopek et al., Engineering light-inducible nuclear localization signals for precise spatiotemporal control of protein dynamics in living cells, Nat Commun. 5:4404 (2014), Di Ventura & Kuhlman, Go in! Go out! Inducible control of nuclear localization, Curr Opin Chem Biol. 34:62-71 (2016), and Shin et al., Cytosolic microRNA-inducible nuclear translocation of Cas9 protein for disease-specific genome modification, Nucleic Acids Res. 50(10):5919-33 (2022), the entire contents of which are incorporated herein by reference. In some embodiments, a switchable nuclear-localization sequence comprises a sequence encoding a sensitized variant of the human estrogen receptor, ERT2, which can be activated by tamoxifen metabolite trans-4-OH-Tamoxifen (trans-4-OHT). See, e.g., Li et al., Multidimensional control of therapeutic human cell function with synthetic gene circuits, Science 378(6625):1227-34 (2022), the entire contents of which are incorporated herein by reference.

Fusion Proteins
Without a KRAB Domain

In some embodiments, a fusion protein comprises, from N-terminus to C-terminus:
a) a H3K4me0 (e.g., a 12-aa or a 30-aa N-terminal fragment of SEQ ID NO:393, 394, 395 or 396, such as the sequence set forth in SEQ ID NO:81 or 87), a DNMT3 methyltransferase-binding domain (e.g., a Dnmt3L C-terminal domain), and a DNA-binding domain (e.g., Cas (e.g., a *Staphylococcus aureus* dCas9, a *Streptococcus pyogenes* dCas9, a *S. aureus* dCas9 or a Cas12a), ZFP or TALE);
b) a H3K4me0 (e.g., a 12-aa or a 30-aa N-terminal fragment of SEQ ID NO:393, 394, 395 or 396, such as the sequence set forth in SEQ ID NO:81 or 87), a DNA-binding domain (e.g., Cas (e.g., *Staphylococcus aureus* dCas9, *Streptococcus pyogenes* dCas9, *S. aureus* dCas9, dCas12a or dCas12f), ZFP or TALE), and a DNMT3 methyltransferase-binding domain (e.g., a Dnmt3L C-terminal domain);
c) a DNA-binding domain (e.g., Cas (e.g., *Staphylococcus aureus* dCas9, *Streptococcus pyogenes* dCas9, *S. aureus* dCas9, dCas12a or dCas12f), ZFP or TALE), a DNMT3 methyltransferase-binding domain (e.g., a Dnmt3L C-terminal domain), and a H3K4me0 (e.g., a 12-aa or a 30-aa N-terminal fragment of SEQ ID NO:393, 394, 395 or 396, such as the sequence set forth in SEQ ID NO:81 or 87);
d) a DNMT3 methyltransferase-binding domain (e.g., a Dnmt3L C-terminal domain), a DNA-binding domain (e.g., Cas (e.g., *Staphylococcus aureus* dCas9, *Streptococcus pyogenes* dCas9, *S. aureus* dCas9, dCas12a or dCas12f), ZFP or TALE), and a H3K4me0 (e.g., a 12-aa or a 30-aa N-terminal fragment of SEQ ID NO:393, 394, 395 or 396, such as the sequence set forth in SEQ ID NO:81 or 87);
e) a DNMT3 methyltransferase-binding domain (e.g., a Dnmt3L C-terminal domain), a H3K4me0 (e.g., a 12-aa or a 30-aa N-terminal fragment of SEQ ID NO:393, 394, 395 or 396, such as the sequence set forth in SEQ ID NO:81 or 87), and a DNA-binding domain (e.g., Cas (e.g., *Staphylococcus aureus* dCas9, *Streptococcus pyogenes* dCas9, *S. aureus* dCas9, dCas12a or dCas12f), ZFP or TALE); or
f) a DNA-binding domain (e.g., Cas (e.g., *Staphylococcus aureus* dCas9, *Streptococcus pyogenes* dCas9, *S. aureus* dCas9, dCas12a or dCas12f), ZFP or TALE), a H3K4me0 (e.g., a 12-aa or a 30-aa N-terminal fragment of SEQ ID NO:393, 394, 395 or 396, such as the sequence set forth in SEQ ID NO:81 or 87), and a DNMT3 methyltransferase-binding domain (e.g., a Dnmt3L C-terminal domain).

In some embodiments, a fusion protein comprises, from N-terminus to C-terminus:
a) a H3K4me0 (e.g., a 12-aa or a 30-aa N-terminal fragment of SEQ ID NO:393, 394, 395 or 396, such as the sequence set forth in SEQ ID NO:81 or 87), a Dnmt3L (e.g., *Mus musculus* or *Apodemus sylvaticus* DNMT3L) C-terminal domain, and a DNA-binding domain (e.g., Cas (e.g., *Staphylococcus aureus* dCas9, *Streptococcus pyogenes* dCas9, *S. aureus* dCas9, dCas12a or dCas12f), ZFP or TALE);
b) a H3K4me0 (e.g., a 12-aa or a 30-aa N-terminal fragment of SEQ ID NO:393, 394, 395 or 396, such as the sequence set forth in SEQ ID NO:81 or 87), a DNA-binding domain (e.g., Cas (e.g., *Staphylococcus aureus* dCas9, *Streptococcus pyogenes* dCas9, *S. aureus* dCas9, dCas12a or dCas12f), ZFP or TALE), and a Dnmt3L (e.g., *Mus musculus* or *Apodemus sylvaticus* DNMT3L) C-terminal domain;
c) a DNA-binding domain (e.g., Cas (e.g., *Staphylococcus aureus* dCas9, *Streptococcus pyogenes* dCas9, *S. aureus* dCas9, dCas12a or dCas12f), ZFP or TALE), a Dnmt3L (e.g., *Mus musculus* or *Apodemus sylvaticus* DNMT3L) C-terminal domain, and a H3K4me0 (e.g., a 12-aa or a 30-aa N-terminal fragment of SEQ ID NO:393, 394, 395 or 396, such as the sequence set forth in SEQ ID NO:81 or 87);
d) a Dnmt3L (e.g., *Mus musculus* or *Apodemus sylvaticus* DNMT3L) C-terminal domain, a DNA-binding domain (e.g., Cas (e.g., *Staphylococcus aureus* dCas9, *Streptococcus pyogenes* dCas9, *S. aureus* dCas9, dCas12a or dCas12f), ZFP or TALE), and a H3K4me0 (e.g., a 12-aa or a 30-aa N-terminal fragment of SEQ ID NO:393, 394, 395 or 396, such as the sequence set forth in SEQ ID NO:81 or 87);
e) a Dnmt3L (e.g., *Mus musculus* or *Apodemus sylvaticus* DNMT3L) C-terminal domain, a H3K4me0 (e.g., a 12-aa or a 30-aa N-terminal fragment of SEQ ID NO:393, 394, 395 or 396, such as the sequence set forth in SEQ ID NO:81 or 87), and a DNA-binding domain (e.g., Cas (e.g., *Staphylococcus aureus* dCas9, *Streptococcus pyogenes* dCas9, *S. aureus* dCas9, dCas12a or dCas12f), ZFP or TALE); or
f) a DNA-binding domain (e.g., Cas (e.g., *Staphylococcus aureus* dCas9, *Streptococcus pyogenes* dCas9, *S. aureus* dCas9, dCas12a or dCas12f), ZFP or TALE), a H3K4me0 (e.g., a 12-aa or a 30-aa N-terminal fragment of SEQ ID NO:393, 394, 395 or 396, such as the sequence set forth in SEQ ID NO:81 or 87), and a Dnmt3L (e.g., *Mus musculus* or *Apodemus sylvaticus* DNMT3L) C-terminal domain.

In some embodiments, a fusion protein comprises, from N-terminus to C-terminus:
a) a H3K4me0 (e.g., a 12-aa or a 30-aa N-terminal fragment of SEQ ID NO:393, 394, 395 or 396, such as the sequence set forth in SEQ ID NO:81 or 87), a DNMT3 methyltransferase-binding domain (e.g., a Dnmt3L C-terminal domain), and a Cas (e.g., *Staphylococcus aureus* dCas9, *Streptococcus pyogenes* dCas9, *S. aureus* dCas9, dCas12a or dCas12f);
b) a H3K4me0 (e.g., a 12-aa or a 30-aa N-terminal fragment of SEQ ID NO:393, 394, 395 or 396, such as the sequence set forth in SEQ ID NO:81 or 87), a Cas (e.g., *Staphylococcus aureus* dCas9, *Streptococcus pyogenes* dCas9, *S. aureus* dCas9, dCas12a or dCas12f), and a DNMT3 methyltransferase-binding domain (e.g., a Dnmt3L C-terminal domain);
c) a Cas (e.g., *Staphylococcus aureus* dCas9, *Streptococcus pyogenes* dCas9, *S. aureus* dCas9, dCas12a or dCas12f), a DNMT3 methyltransferase-binding domain (e.g., a Dnmt3L C-terminal domain), and a H3K4me0 (e.g., a 12-aa or a 30-aa N-terminal fragment of SEQ ID NO:393, 394, 395 or 396, such as the sequence set forth in SEQ ID NO:81 or 87);
d) a DNMT3 methyltransferase-binding domain (e.g., a Dnmt3L C-terminal domain), a Cas (e.g., *Staphylococcus aureus* dCas9, *Streptococcus pyogenes* dCas9, *S. aureus* dCas9, dCas12a or dCas12f), and a H3K4me0 (e.g., a 12-aa or a 30-aa N-terminal fragment of SEQ ID NO:393, 394, 395 or 396, such as the sequence set forth in SEQ ID NO:81 or 87);
e) a DNMT3 methyltransferase-binding domain (e.g., a Dnmt3L C-terminal domain), a H3K4me0 (e.g., a 12-aa or a 30-aa N-terminal fragment of SEQ ID NO:393, 394, 395 or 396, such as the sequence set forth in SEQ ID NO:81 or 87), and a Cas (e.g., *Staphylococcus aureus* dCas9, *Streptococcus pyogenes* dCas9, *S. aureus* dCas9, dCas12a or dCas12f); or f) a Cas (e.g., *Staphylococcus aureus* dCas9, *Streptococcus pyogenes* dCas9, *S. aureus* dCas9, dCas12a or dCas12f), a H3K4me0 (e.g., a 12-aa or a 30-aa N-terminal fragment of SEQ ID NO:393, 394, 395 or 396, such as the sequence set forth in SEQ ID NO:81 or 87), and a DNMT3 methyltransferase-binding domain (e.g., a Dnmt3L C-terminal domain).

In some embodiments, a fusion protein comprises, from N-terminus to C-terminus:
- a) a H3K4me0 (e.g., a 12-aa or a 30-aa N-terminal fragment of SEQ ID NO:393, 394, 395 or 396, such as the sequence set forth in SEQ ID NO:81 or 87), a Dnmt3L (e.g., *Mus musculus* or *Apodemus sylvaticus* DNMT3L) C-terminal domain, and a Cas (e.g., *Staphylococcus aureus* dCas9, *Streptococcus pyogenes* dCas9, *S. aureus* dCas9, dCas12a or dCas12f);
- b) a H3K4me0 (e.g., a 12-aa or a 30-aa N-terminal fragment of SEQ ID NO:393, 394, 395 or 396, such as the sequence set forth in SEQ ID NO:81 or 87), a Cas (e.g., *Staphylococcus aureus* dCas9, *Streptococcus pyogenes* dCas9, *S. aureus* dCas9, dCas12a or dCas12f), and a Dnmt3L (e.g., *Mus musculus* or *Apodemus sylvaticus* DNMT3L) C-terminal domain;
- c) a Cas (e.g., *Staphylococcus aureus* dCas9, *Streptococcus pyogenes* dCas9, *S. aureus* dCas9, dCas12a or dCas12f), a Dnmt3L (e.g., *Mus musculus* or *Apodemus sylvaticus* DNMT3L) C-terminal domain, and a H3K4me0 (e.g., a 12-aa or a 30-aa N-terminal fragment of SEQ ID NO:393, 394, 395 or 396, such as the sequence set forth in SEQ ID NO:81 or 87);
- d) a Dnmt3L (e.g., *Mus musculus* or *Apodemus sylvaticus* DNMT3L) C-terminal domain, a Cas (e.g., *Staphylococcus aureus* dCas9, *Streptococcus pyogenes* dCas9, *S. aureus* dCas9, dCas12a or dCas12f), and a H3K4me0 (e.g., a 12-aa or a 30-aa N-terminal fragment of SEQ ID NO:393, 394, 395 or 396, such as the sequence set forth in SEQ ID NO:81 or 87);
- e) a Dnmt3L (e.g., *Mus musculus* or *Apodemus sylvaticus* DNMT3L) C-terminal domain, a H3K4me0 (e.g., a 12-aa or a 30-aa N-terminal fragment of SEQ ID NO:393, 394, 395 or 396, such as the sequence set forth in SEQ ID NO:81 or 87), and a Cas (e.g., *Staphylococcus aureus* dCas9, *Streptococcus pyogenes* dCas9, *S. aureus* dCas9, dCas12a or dCas12f); or
- f) a Cas (e.g., *Staphylococcus aureus* dCas9, *Streptococcus pyogenes* dCas9, *S. aureus* dCas9, dCas12a or dCas12f), a H3K4me0 (e.g., a 12-aa or a 30-aa N-terminal fragment of SEQ ID NO:393, 394, 395 or 396, such as the sequence set forth in SEQ ID NO:81 or 87), and a Dnmt3L (e.g., *Mus musculus* or *Apodemus sylvaticus* DNMT3L) C-terminal domain.

In some embodiments, a fusion protein comprises, from N-terminus to C-terminus:
- a) a H3K4me0 (e.g., a 12-aa or a 30-aa N-terminal fragment of SEQ ID NO:393, 394, 395 or 396, such as the sequence set forth in SEQ ID NO:81 or 87), a DNMT3 methyltransferase-binding domain (e.g., a Dnmt3L C-terminal domain), and a ZFP;
- b) a H3K4me0 (e.g., a 12-aa or a 30-aa N-terminal fragment of SEQ ID NO:393, 394, 395 or 396, such as the sequence set forth in SEQ ID NO:81 or 87), a ZFP, and a DNMT3 methyltransferase-binding domain (e.g., a Dnmt3L C-terminal domain);
- c) a ZFP, a DNMT3 methyltransferase-binding domain (e.g., a Dnmt3L C-terminal domain), and a H3K4me0 (e.g., a 12-aa or a 30-aa N-terminal fragment of SEQ ID NO:393, 394, 395 or 396, such as the sequence set forth in SEQ ID NO:81 or 87);
- d) a DNMT3 methyltransferase-binding domain (e.g., a Dnmt3L C-terminal domain), a ZFP, and a H3K4me0 (e.g., a 12-aa or a 30-aa N-terminal fragment of SEQ ID NO:393, 394, 395 or 396, such as the sequence set forth in SEQ ID NO:81 or 87);
- e) a DNMT3 methyltransferase-binding domain (e.g., a Dnmt3L C-terminal domain), a H3K4me0 (e.g., a 12-aa or a 30-aa N-terminal fragment of SEQ ID NO:393, 394, 395 or 396, such as the sequence set forth in SEQ ID NO:81 or 87), and a ZFP; or
- f) a ZFP, a H3K4me0 (e.g., a 12-aa or a 30-aa N-terminal fragment of SEQ ID NO:393, 394, 395 or 396, such as the sequence set forth in SEQ ID NO:81 or 87), and a DNMT3 methyltransferase-binding domain (e.g., a Dnmt3L C-terminal domain).

In some embodiments, a fusion protein comprises, from N-terminus to C-terminus:
- a) a H3K4me0 (e.g., a 12-aa or a 30-aa N-terminal fragment of SEQ ID NO:393, 394, 395 or 396, such as the sequence set forth in SEQ ID NO:81 or 87), a Dnmt3L (e.g., *Mus musculus* or *Apodemus sylvaticus* DNMT3L) C-terminal domain, and a ZFP;
- b) a H3K4me0 (e.g., a 12-aa or a 30-aa N-terminal fragment of SEQ ID NO:393, 394, 395 or 396, such as the sequence set forth in SEQ ID NO:81 or 87), a ZFP, and a Dnmt3L (e.g., *Mus musculus* or *Apodemus sylvaticus* DNMT3L) C-terminal domain;
- c) a ZFP, a Dnmt3L (e.g., *Mus musculus* or *Apodemus sylvaticus* DNMT3L) C-terminal domain, and a H3K4me0 (e.g., a 12-aa or a 30-aa N-terminal fragment of SEQ ID NO:393, 394, 395 or 396, such as the sequence set forth in SEQ ID NO:81 or 87);
- d) a Dnmt3L (e.g., *Mus musculus* or *Apodemus sylvaticus* DNMT3L) C-terminal domain, a ZFP, and a H3K4me0 (e.g., a 12-aa or a 30-aa N-terminal fragment of SEQ ID NO:393, 394, 395 or 396, such as the sequence set forth in SEQ ID NO:81 or 87);
- e) a Dnmt3L (e.g., *Mus musculus* or *Apodemus sylvaticus* DNMT3L) C-terminal domain, a H3K4me0 (e.g., a 12-aa or a 30-aa N-terminal fragment of SEQ ID NO:393, 394, 395 or 396, such as the sequence set forth in SEQ ID NO:81 or 87), and a ZFP; or
- f) a ZFP, a H3K4me0 (e.g., a 12-aa or a 30-aa N-terminal fragment of SEQ ID NO:393, 394, 395 or 396, such as the sequence set forth in SEQ ID NO:81 or 87), and a Dnmt3L (e.g., *Mus musculus* or *Apodemus sylvaticus* DNMT3L) C-terminal domain.

In some embodiments, a fusion protein comprises, from N-terminus to C-terminus:
- a) a H3K4me0 (e.g., a 12-aa or a 30-aa N-terminal fragment of SEQ ID NO:393, 394, 395 or 396, such as the sequence set forth in SEQ ID NO:81 or 87), a DNMT3 methyltransferase-binding domain (e.g., a Dnmt3L C-terminal domain), and a TALE;
- b) a H3K4me0 (e.g., a 12-aa or a 30-aa N-terminal fragment of SEQ ID NO:393, 394, 395 or 396, such as the sequence set forth in SEQ ID NO:81 or 87), a TALE, and a DNMT3 methyltransferase-binding domain (e.g., a Dnmt3L C-terminal domain);

c) a TALE, a DNMT3 methyltransferase-binding domain (e.g., a Dnmt3L C-terminal domain), and a H3K4me0 (e.g., a 12-aa or a 30-aa N-terminal fragment of SEQ ID NO:393, 394, 395 or 396, such as the sequence set forth in SEQ ID NO:81 or 87);

d) a DNMT3 methyltransferase-binding domain (e.g., a Dnmt3L C-terminal domain), a TALE, and a H3K4me0 (e.g., a 12-aa or a 30-aa N-terminal fragment of SEQ ID NO:393, 394, 395 or 396, such as the sequence set forth in SEQ ID NO:81 or 87);

e) a DNMT3 methyltransferase-binding domain (e.g., a Dnmt3L C-terminal domain), a H3K4me0 (e.g., a 12-aa or a 30-aa N-terminal fragment of SEQ ID NO:393, 394, 395 or 396, such as the sequence set forth in SEQ ID NO:81 or 87), and a TALE; or f) a TALE, a H3K4me0 (e.g., a 12-aa or a 30-aa N-terminal fragment of SEQ ID NO:393, 394, 395 or 396, such as the sequence set forth in SEQ ID NO:81 or 87), and a DNMT3 methyltransferase-binding domain (e.g., a Dnmt3L C-terminal domain).

In some embodiments, a fusion protein comprises, from N-terminus to C-terminus:

a) a H3K4me0 (e.g., a 12-aa or a 30-aa N-terminal fragment of SEQ ID NO:393, 394, 395 or 396, such as the sequence set forth in SEQ ID NO:81 or 87), a Dnmt3L (e.g., *Mus musculus* or *Apodemus sylvaticus* DNMT3L) C-terminal domain, and a TALE;

b) a H3K4me0 (e.g., a 12-aa or a 30-aa N-terminal fragment of SEQ ID NO:393, 394, 395 or 396, such as the sequence set forth in SEQ ID NO:81 or 87), a TALE, and a Dnmt3L (e.g., *Mus musculus* or *Apodemus sylvaticus* DNMT3L) C-terminal domain;

c) a TALE, a Dnmt3L (e.g., *Mus musculus* or *Apodemus sylvaticus* DNMT3L) C-terminal domain, and a H3K4me0 (e.g., a 12-aa or a 30-aa N-terminal fragment of SEQ ID NO:393, 394, 395 or 396, such as the sequence set forth in SEQ ID NO:81 or 87);

d) a Dnmt3L (e.g., *Mus musculus* or *Apodemus sylvaticus* DNMT3L) C-terminal domain, a TALE, and a H3K4me0 (e.g., a 12-aa or a 30-aa N-terminal fragment of SEQ ID NO:393, 394, 395 or 396, such as the sequence set forth in SEQ ID NO:81 or 87);

e) a Dnmt3L (e.g., *Mus musculus* or *Apodemus sylvaticus* DNMT3L) C-terminal domain, a H3K4me0 (e.g., a 12-aa or a 30-aa N-terminal fragment of SEQ ID NO:393, 394, 395 or 396, such as the sequence set forth in SEQ ID NO:81 or 87), and a TALE; or f) a TALE, a H3K4me0 (e.g., a 12-aa or a 30-aa N-terminal fragment of SEQ ID NO:393, 394, 395 or 396, such as the sequence set forth in SEQ ID NO:81 or 87), and a Dnmt3L (e.g., *Mus musculus* or *Apodemus sylvaticus* DNMT3L) C-terminal domain.

In some embodiments, a fusion protein comprises, from N-terminus to C-terminus:

a) a H3K4me0 (e.g., a 12-aa or a 30-aa N-terminal fragment of SEQ ID NO:393, 394, 395 or 396, such as the sequence set forth in SEQ ID NO:81 or 87), a DNMT3 methyltransferase-binding domain (e.g., a Dnmt3L C-terminal domain), and a DNA-binding domain (e.g., Cas (e.g., *Staphylococcus aureus* dCas9, *Streptococcus pyogenes* dCas9, *S. aureus* dCas9, dCas12a or dCas12f), ZFP or TALE);

b) a H3K4me0 (e.g., a 12-aa or a 30-aa N-terminal fragment of SEQ ID NO:393, 394, 395 or 396, such as the sequence set forth in SEQ ID NO:81 or 87), a DNA-binding domain (e.g., Cas (e.g., *Staphylococcus aureus* dCas9, *Streptococcus pyogenes* dCas9, *S. aureus* dCas9, dCas12a or dCas12f), ZFP or TALE), and a DNMT3 methyltransferase-binding domain (e.g., a Dnmt3L C-terminal domain);

c) a DNA-binding domain (e.g., Cas (e.g., *Staphylococcus aureus* dCas9, *Streptococcus pyogenes* dCas9, *S. aureus* dCas9, dCas12a or dCas12f), ZFP or TALE), a DNMT3 methyltransferase-binding domain (e.g., a Dnmt3L C-terminal domain), and a H3K4me0 (e.g., a 12-aa or a 30-aa N-terminal fragment of SEQ ID NO:393, 394, 395 or 396, such as the sequence set forth in SEQ ID NO:81 or 87); or d) a DNMT3 methyltransferase-binding domain (e.g., a Dnmt3L C-terminal domain), a DNA-binding domain (e.g., Cas (e.g., *Staphylococcus aureus* dCas9, *Streptococcus pyogenes* dCas9, *S. aureus* dCas9, dCas12a or dCas12f), ZFP or TALE), and a H3K4me0 (e.g., a 12-aa or a 30-aa N-terminal fragment of SEQ ID NO:393, 394, 395 or 396, such as the sequence set forth in SEQ ID NO:81 or 87).

In some embodiments, a fusion protein comprises, from N-terminus to C-terminus:

a) a H3K4me0 (e.g., a 12-aa or a 30-aa N-terminal fragment of SEQ ID NO:393, 394, 395 or 396, such as the sequence set forth in SEQ ID NO:81 or 87), a Dnmt3L (e.g., *Mus musculus* or *Apodemus sylvaticus* DNMT3L) C-terminal domain, and a DNA-binding domain (e.g., Cas (e.g., *Staphylococcus aureus* dCas9, *Streptococcus pyogenes* dCas9, *S. aureus* dCas9, dCas12a or dCas12f), ZFP or TALE);

b) a H3K4me0 (e.g., a 12-aa or a 30-aa N-terminal fragment of SEQ ID NO:393, 394, 395 or 396, such as the sequence set forth in SEQ ID NO:81 or 87), a DNA-binding domain (e.g., Cas (e.g., *Staphylococcus aureus* dCas9, *Streptococcus pyogenes* dCas9, *S. aureus* dCas9, dCas12a or dCas12f), ZFP or TALE), and a Dnmt3L (e.g., *Mus musculus* or *Apodemus sylvaticus* DNMT3L) C-terminal domain;

c) a DNA-binding domain (e.g., Cas (e.g., *Staphylococcus aureus* dCas9, *Streptococcus pyogenes* dCas9, *S. aureus* dCas9, dCas12a or dCas12f), ZFP or TALE), a Dnmt3L (e.g., *Mus musculus* or *Apodemus sylvaticus* DNMT3L) C-terminal domain, and a H3K4me0 (e.g., a 12-aa or a 30-aa N-terminal fragment of SEQ ID NO:393, 394, 395 or 396, such as the sequence set forth in SEQ ID NO:81 or 87); or d) a Dnmt3L (e.g., *Mus musculus* or *Apodemus sylvaticus* DNMT3L) C-terminal domain, a DNA-binding domain (e.g., Cas (e.g., *Staphylococcus aureus* dCas9, *Streptococcus pyogenes* dCas9, *S. aureus* dCas9, dCas12a or dCas12f), ZFP or TALE), and a H3K4me0 (e.g., a 12-aa or a 30-aa N-terminal fragment of SEQ ID NO:393, 394, 395 or 396, such as the sequence set forth in SEQ ID NO:81 or 87).

In some embodiments, a fusion protein comprises, from N-terminus to C-terminus:

a) a H3K4me0 (e.g., a 12-aa or a 30-aa N-terminal fragment of SEQ ID NO:393, 394, 395 or 396, such as the sequence set forth in SEQ ID NO:81 or 87), a DNMT3 methyltransferase-binding domain (e.g., a Dnmt3L C-terminal domain), and a Cas (e.g., *Staphylococcus aureus* dCas9, *Streptococcus pyogenes* dCas9, *S. aureus* dCas9, dCas12a or dCas12f);

b) a H3K4me0 (e.g., a 12-aa or a 30-aa N-terminal fragment of SEQ ID NO:393, 394, 395 or 396, such as the sequence set forth in SEQ ID NO:81 or 87), a Cas (e.g., *Staphylococcus aureus* dCas9, *Streptococcus pyogenes* dCas9, *S. aureus* dCas9, dCas12a or dCas12f), and a DNMT3 methyltransferase-binding domain (e.g., a Dnmt3L C-terminal domain);
c) a Cas (e.g., *Staphylococcus aureus* dCas9, *Streptococcus pyogenes* dCas9, *S. aureus* dCas9, dCas12a or dCas12f), a DNMT3 methyltransferase-binding domain (e.g., a Dnmt3L C-terminal domain), and a H3K4me0 (e.g., a 12-aa or a 30-aa N-terminal fragment of SEQ ID NO:393, 394, 395 or 396, such as the sequence set forth in SEQ ID NO:81 or 87); or
d) a DNMT3 methyltransferase-binding domain (e.g., a Dnmt3L C-terminal domain), a Cas (e.g., *Staphylococcus aureus* dCas9, *Streptococcus pyogenes* dCas9, *S. aureus* dCas9, dCas12a or dCas12f), and a H3K4me0 (e.g., a 12-aa or a 30-aa N-terminal fragment of SEQ ID NO:393, 394, 395 or 396, such as the sequence set forth in SEQ ID NO:81 or 87).

In some embodiments, a fusion protein comprises, from N-terminus to C-terminus:
a) a H3K4me0 (e.g., a 12-aa or a 30-aa N-terminal fragment of SEQ ID NO:393, 394, 395 or 396, such as the sequence set forth in SEQ ID NO:81 or 87), a Dnmt3L (e.g., *Mus musculus* or *Apodemus sylvaticus* DNMT3L) C-terminal domain, and a Cas (e.g., *Staphylococcus aureus* dCas9, *Streptococcus pyogenes* dCas9, *S. aureus* dCas9, dCas12a or dCas12f);
b) a H3K4me0 (e.g., a 12-aa or a 30-aa N-terminal fragment of SEQ ID NO:393, 394, 395 or 396, such as the sequence set forth in SEQ ID NO:81 or 87), a Cas (e.g., *Staphylococcus aureus* dCas9, *Streptococcus pyogenes* dCas9, *S. aureus* dCas9, dCas12a or dCas12f), and a Dnmt3L (e.g., *Mus musculus* or *Apodemus sylvaticus* DNMT3L) C-terminal domain;
c) a Cas (e.g., *Staphylococcus aureus* dCas9, *Streptococcus pyogenes* dCas9, *S. aureus* dCas9, dCas12a or dCas12f), a Dnmt3L (e.g., *Mus musculus* or *Apodemus sylvaticus* DNMT3L) C-terminal domain, and a H3K4me0 (e.g., a 12-aa or a 30-aa N-terminal fragment of SEQ ID NO:393, 394, 395 or 396, such as the sequence set forth in SEQ ID NO:81 or 87); or
d) a Dnmt3L (e.g., *Mus musculus* or *Apodemus sylvaticus* DNMT3L) C-terminal domain, a Cas (e.g., *Staphylococcus aureus* dCas9, *Streptococcus pyogenes* dCas9, *S. aureus* dCas9, dCas12a or dCas12f), and a H3K4me0 (e.g., a 12-aa or a 30-aa N-terminal fragment of SEQ ID NO:393, 394, 395 or 396, such as the sequence set forth in SEQ ID NO:81 or 87).

In some embodiments, a fusion protein comprises, from N-terminus to C-terminus:
a) a H3K4me0 (e.g., a 12-aa or a 30-aa N-terminal fragment of SEQ ID NO:393, 394, 395 or 396, such as the sequence set forth in SEQ ID NO:81 or 87), a DNMT3 methyltransferase-binding domain (e.g., a Dnmt3L C-terminal domain), and a ZFP;
b) a H3K4me0 (e.g., a 12-aa or a 30-aa N-terminal fragment of SEQ ID NO:393, 394, 395 or 396, such as the sequence set forth in SEQ ID NO:81 or 87), a ZFP, and a DNMT3 methyltransferase-binding domain (e.g., a Dnmt3L C-terminal domain);
c) a ZFP, a DNMT3 methyltransferase-binding domain (e.g., a Dnmt3L C-terminal domain), and a H3K4me0 (e.g., a 12-aa or a 30-aa N-terminal fragment of SEQ ID NO:393, 394, 395 or 396, such as the sequence set forth in SEQ ID NO:81 or 87); or
d) a DNMT3 methyltransferase-binding domain (e.g., a Dnmt3L C-terminal domain), a ZFP, and a H3K4me0 (e.g., a 12-aa or a 30-aa N-terminal fragment of SEQ ID NO:393, 394, 395 or 396, such as the sequence set forth in SEQ ID NO:81 or 87).

In some embodiments, a fusion protein comprises, from N-terminus to C-terminus:
a) a H3K4me0 (e.g., a 12-aa or a 30-aa N-terminal fragment of SEQ ID NO:393, 394, 395 or 396, such as the sequence set forth in SEQ ID NO:81 or 87), a Dnmt3L (e.g., *Mus musculus* or *Apodemus sylvaticus* DNMT3L) C-terminal domain, and a ZFP;
b) a H3K4me0 (e.g., a 12-aa or a 30-aa N-terminal fragment of SEQ ID NO:393, 394, 395 or 396, such as the sequence set forth in SEQ ID NO:81 or 87), a ZFP, and a Dnmt3L (e.g., *Mus musculus* or *Apodemus sylvaticus* DNMT3L) C-terminal domain;
c) a ZFP, a Dnmt3L (e.g., *Mus musculus* or *Apodemus sylvaticus* DNMT3L) C-terminal domain, and a H3K4me0 (e.g., a 12-aa or a 30-aa N-terminal fragment of SEQ ID NO:393, 394, 395 or 396, such as the sequence set forth in SEQ ID NO:81 or 87); or
d) a Dnmt3L (e.g., *Mus musculus* or *Apodemus sylvaticus* DNMT3L) C-terminal domain, a ZFP, and a H3K4me0 (e.g., a 12-aa or a 30-aa N-terminal fragment of SEQ ID NO:393, 394, 395 or 396, such as the sequence set forth in SEQ ID NO:81 or 87).

In some embodiments, a fusion protein comprises, from N-terminus to C-terminus:
a) a H3K4me0 (e.g., a 12-aa or a 30-aa N-terminal fragment of SEQ ID NO:393, 394, 395 or 396, such as the sequence set forth in SEQ ID NO:81 or 87), a DNMT3 methyltransferase-binding domain (e.g., a Dnmt3L C-terminal domain), and a TALE;
b) a H3K4me0 (e.g., a 12-aa or a 30-aa N-terminal fragment of SEQ ID NO:393, 394, 395 or 396, such as the sequence set forth in SEQ ID NO:81 or 87), a TALE, and a DNMT3 methyltransferase-binding domain (e.g., a Dnmt3L C-terminal domain);
c) a TALE, a DNMT3 methyltransferase-binding domain (e.g., a Dnmt3L C-terminal domain), and a H3K4me0 (e.g., a 12-aa or a 30-aa N-terminal fragment of SEQ ID NO:393, 394, 395 or 396, such as the sequence set forth in SEQ ID NO:81 or 87); or
d) a DNMT3 methyltransferase-binding domain (e.g., a Dnmt3L C-terminal domain), a TALE, and a H3K4me0 (e.g., a 12-aa or a 30-aa N-terminal fragment of SEQ ID NO:393, 394, 395 or 396, such as the sequence set forth in SEQ ID NO:81 or 87).

In some embodiments, a fusion protein comprises, from N-terminus to C-terminus:
a) a H3K4me0 (e.g., a 12-aa or a 30-aa N-terminal fragment of SEQ ID NO:393, 394, 395 or 396, such as the sequence set forth in SEQ ID NO:81 or 87), a Dnmt3L (e.g., *Mus musculus* or *Apodemus sylvaticus* DNMT3L) C-terminal domain, and a TALE;
b) a H3K4me0 (e.g., a 12-aa or a 30-aa N-terminal fragment of SEQ ID NO:393, 394, 395 or 396, such as the sequence set forth in SEQ ID NO:81 or 87), a TALE, and a Dnmt3L (e.g., *Mus musculus* or *Apodemus sylvaticus* DNMT3L) C-terminal domain;
c) a TALE, a Dnmt3L (e.g., *Mus musculus* or *Apodemus sylvaticus* DNMT3L) C-terminal domain, and a H3K4me0 (e.g., a 12-aa or a 30-aa N-terminal fragment of SEQ ID NO:393, 394, 395 or 396, such as the sequence set forth in SEQ ID NO:81 or 87); or
d) a Dnmt3L (e.g., *Mus musculus* or *Apodemus sylvaticus* DNMT3L) C-terminal domain, a TALE, and a H3K4me0 (e.g., a 12-aa or a 30-aa N-terminal fragment of SEQ ID NO:393, 394, 395 or 396, such as the sequence set forth in SEQ ID NO:81 or 87).

In some embodiments, a fusion protein comprises, from N-terminus to C-terminus:
a) a H3K4me0 (e.g., a 12-aa or a 30-aa N-terminal fragment of SEQ ID NO:393, 394, 395 or 396, such as the sequence set forth in SEQ ID NO:81 or 87), a DNMT3 methyltransferase-binding domain (e.g., a Dnmt3L C-terminal domain), and a DNA-binding domain (e.g., Cas (e.g., *Staphylococcus aureus* dCas9, *Streptococcus pyogenes* dCas9, *S. aureus* dCas9, dCas12a or dCas12f), ZFP or TALE); or
b) a H3K4me0 (e.g., a 12-aa or a 30-aa N-terminal fragment of SEQ ID NO:393, 394, 395 or 396, such as the sequence set forth in SEQ ID NO:81 or 87), a DNA-binding domain (e.g., Cas (e.g., *Staphylococcus aureus* dCas9, *Streptococcus pyogenes* dCas9, *S. aureus* dCas9, dCas12a or dCas12f), ZFP or TALE), and a DNMT3 methyltransferase-binding domain (e.g., a Dnmt3L C-terminal domain).

In some embodiments, a fusion protein comprises, from N-terminus to C-terminus:
a) a H3K4me0 (e.g., a 12-aa or a 30-aa N-terminal fragment of SEQ ID NO:393, 394, 395 or 396, such as the sequence set forth in SEQ ID NO:81 or 87), a Dnmt3L (e.g., *Mus musculus* or *Apodemus sylvaticus* DNMT3L) C-terminal domain, and a DNA-binding domain (e.g., Cas (e.g., *Staphylococcus aureus* dCas9, *Streptococcus pyogenes* dCas9, *S. aureus* dCas9, dCas12a or dCas12f), ZFP or TALE); or
b) a H3K4me0 (e.g., a 12-aa or a 30-aa N-terminal fragment of SEQ ID NO:393, 394, 395 or 396, such as the sequence set forth in SEQ ID NO:81 or 87), a DNA-binding domain (e.g., Cas (e.g., *Staphylococcus aureus* dCas9, *Streptococcus pyogenes* dCas9, *S. aureus* dCas9, dCas12a or dCas12f), ZFP or TALE), and a Dnmt3L (e.g., *Mus musculus* or *Apodemus sylvaticus* DNMT3L) C-terminal domain.

In some embodiments, a fusion protein comprises, from N-terminus to C-terminus:
a) a H3K4me0 (e.g., a 12-aa or a 30-aa N-terminal fragment of SEQ ID NO:393, 394, 395 or 396, such as the sequence set forth in SEQ ID NO:81 or 87), a DNMT3 methyltransferase-binding domain (e.g., a Dnmt3L C-terminal domain), and a Cas (e.g., *Staphylococcus aureus* dCas9, *Streptococcus pyogenes* dCas9, *S. aureus* dCas9, dCas12a or dCas12f); or
b) a H3K4me0 (e.g., a 12-aa or a 30-aa N-terminal fragment of SEQ ID NO:393, 394, 395 or 396, such as the sequence set forth in SEQ ID NO:81 or 87), a Cas (e.g., *Staphylococcus aureus* dCas9, *Streptococcus pyogenes* dCas9, *S. aureus* dCas9, dCas12a or dCas12f), and a DNMT3 methyltransferase-binding domain (e.g., a Dnmt3L C-terminal domain).

In some embodiments, a fusion protein comprises, from N-terminus to C-terminus:
a) a H3K4me0 (e.g., a 12-aa or a 30-aa N-terminal fragment of SEQ ID NO:393, 394, 395 or 396, such as the sequence set forth in SEQ ID NO:81 or 87), a Dnmt3L (e.g., *Mus musculus* or *Apodemus sylvaticus* DNMT3L) C-terminal domain, and a Cas (e.g., *Staphylococcus aureus* dCas9, *Streptococcus pyogenes* dCas9, *S. aureus* dCas9, dCas12a or dCas12f); or
b) a H3K4me0 (e.g., a 12-aa or a 30-aa N-terminal fragment of SEQ ID NO:393, 394, 395 or 396, such as the sequence set forth in SEQ ID NO:81 or 87), a Cas (e.g., *Staphylococcus aureus* dCas9, *Streptococcus pyogenes* dCas9, *S. aureus* dCas9, dCas12a or dCas12f), and a Dnmt3L (e.g., *Mus musculus* or *Apodemus sylvaticus* DNMT3L) C-terminal domain.

In some embodiments, a fusion protein comprises, from N-terminus to C-terminus:
a) a H3K4me0 (e.g., a 12-aa or a 30-aa N-terminal fragment of SEQ ID NO:393, 394, 395 or 396, such as the sequence set forth in SEQ ID NO:81 or 87), a DNMT3 methyltransferase-binding domain (e.g., a Dnmt3L C-terminal domain), and a ZFP; or
b) a H3K4me0 (e.g., a 12-aa or a 30-aa N-terminal fragment of SEQ ID NO:393, 394, 395 or 396, such as the sequence set forth in SEQ ID NO:81 or 87), a ZFP, and a DNMT3 methyltransferase-binding domain (e.g., a Dnmt3L C-terminal domain).

In some embodiments, a fusion protein comprises, from N-terminus to C-terminus:
a) a H3K4me0 (e.g., a 12-aa or a 30-aa N-terminal fragment of SEQ ID NO:393, 394, 395 or 396, such as the sequence set forth in SEQ ID NO:81 or 87), a Dnmt3L (e.g., *Mus musculus* or *Apodemus sylvaticus* DNMT3L) C-terminal domain, and a ZFP; or
b) a H3K4me0 (e.g., a 12-aa or a 30-aa N-terminal fragment of SEQ ID NO:393, 394, 395 or 396, such as the sequence set forth in SEQ ID NO:81 or 87), a ZFP, and a Dnmt3L (e.g., *Mus musculus* or *Apodemus sylvaticus* DNMT3L) C-terminal domain.

In some embodiments, a fusion protein comprises, from N-terminus to C-terminus:
a) a H3K4me0 (e.g., a 12-aa or a 30-aa N-terminal fragment of SEQ ID NO:393, 394, 395 or 396, such as the sequence set forth in SEQ ID NO:81 or 87), a DNMT3 methyltransferase-binding domain (e.g., a Dnmt3L C-terminal domain), and a TALE; or
b) a H3K4me0 (e.g., a 12-aa or a 30-aa N-terminal fragment of SEQ ID NO:393, 394, 395 or 396, such as the sequence set forth in SEQ ID NO:81 or 87), a TALE, and a DNMT3 methyltransferase-binding domain (e.g., a Dnmt3L C-terminal domain).

In some embodiments, a fusion protein comprises, from N-terminus to C-terminus:
a) a H3K4me0 (e.g., a 12-aa or a 30-aa N-terminal fragment of SEQ ID NO:393, 394, 395 or 396, such as the sequence set forth in SEQ ID NO:81 or 87), a Dnmt3L (e.g., *Mus musculus* or *Apodemus sylvaticus* DNMT3L) C-terminal domain, and a TALE; or
b) a H3K4me0 (e.g., a 12-aa or a 30-aa N-terminal fragment of SEQ ID NO:393, 394, 395 or 396, such as the sequence set forth in SEQ ID NO:81 or 87), a TALE, and a Dnmt3L (e.g., *Mus musculus* or *Apodemus sylvaticus* DNMT3L) C-terminal domain.

In some embodiments, a fusion protein comprises, from N-terminus to C-terminus, a H3K4me0 (e.g., a 12-aa or a 30-aa N-terminal fragment of SEQ ID NO:393, 394, 395 or 396, such as the sequence set forth in SEQ ID NO:81 or 87), a DNMT3 methyltransferase-binding domain (e.g., a Dnmt3L C-terminal domain), and a DNA-binding domain (e.g., Cas (e.g., *Staphylococcus aureus* dCas9, *Streptococcus pyogenes* dCas9, *S. aureus* dCas9, dCas12a or dCas12f), ZFP or TALE).

In some embodiments, a fusion protein comprises, from N-terminus to C-terminus, a H3K4me0 (e.g., a 12-aa or a 30-aa N-terminal fragment of SEQ ID NO:393, 394, 395 or 396, such as the sequence set forth in SEQ ID NO:81 or 87), a Dnmt3L (e.g., *Mus musculus* or *Apodemus sylvaticus* DNMT3L) C-terminal domain, and a DNA-binding domain (e.g., Cas (e.g., *Staphylococcus aureus* dCas9, *Streptococcus pyogenes* dCas9, *S. aureus* dCas9, dCas12a or dCas12f), ZFP or TALE).

In some embodiments, a fusion protein comprises, from N-terminus to C-terminus, a H3K4me0 (e.g., a 12-aa or a 30-aa N-terminal fragment of SEQ ID NO:393, 394, 395 or 396, such as the sequence set forth in SEQ ID NO:81 or 87), a DNMT3 methyltransferase-binding domain (e.g., a Dnmt3L C-terminal domain), and a Cas (e.g., *Staphylococcus aureus* dCas9, *Streptococcus pyogenes* dCas9, *S. aureus* dCas9, dCas12a or dCas12f).

In some embodiments, a fusion protein comprises, from N-terminus to C-terminus, a H3K4me0 (e.g., a 12-aa or a 30-aa N-terminal fragment of SEQ ID NO:393, 394, 395 or 396, such as the sequence set forth in SEQ ID NO:81 or 87), a Dnmt3L (e.g., *Mus musculus* or *Apodemus sylvaticus* DNMT3L) C-terminal domain, and a Cas (e.g., *Staphylococcus aureus* dCas9, *Streptococcus pyogenes* dCas9, *S. aureus* dCas9, dCas12a or dCas12f).

In some embodiments, a fusion protein comprises, from N-terminus to C-terminus, a H3K4me0 (e.g., a 12-aa or a 30-aa N-terminal fragment of SEQ ID NO:393, 394, 395 or 396, such as the sequence set forth in SEQ ID NO:81 or 87), a DNMT3 methyltransferase-binding domain (e.g., a Dnmt3L C-terminal domain), and a ZFP.

In some embodiments, a fusion protein comprises, from N-terminus to C-terminus, a H3K4me0 (e.g., a 12-aa or a 30-aa N-terminal fragment of SEQ ID NO:393, 394, 395 or 396, such as the sequence set forth in SEQ ID NO:81 or 87), a Dnmt3L (e.g., *Mus musculus* or *Apodemus sylvaticus* DNMT3L) C-terminal domain, and a ZFP.

In some embodiments, a fusion protein comprises, from N-terminus to C-terminus, a H3K4me0 (e.g., a 12-aa or a 30-aa N-terminal fragment of SEQ ID NO:393, 394, 395 or 396, such as the sequence set forth in SEQ ID NO:81 or 87), a DNMT3 methyltransferase-binding domain (e.g., a Dnmt3L C-terminal domain), and a TALE.

In some embodiments, a fusion protein comprises, from N-terminus to C-terminus, a H3K4me0 (e.g., a 12-aa or a 30-aa N-terminal fragment of SEQ ID NO:393, 394, 395 or 396, such as the sequence set forth in SEQ ID NO:81 or 87), a Dnmt3L (e.g., *Mus musculus* or *Apodemus sylvaticus* DNMT3L) C-terminal domain, and a TALE.

In some embodiments, a fusion protein comprises, from N-terminus to C-terminus, a H3K4me0 (e.g., a 12-aa or a 30-aa N-terminal fragment of SEQ ID NO:393, 394, 395 or 396, such as the sequence set forth in SEQ ID NO:81 or 87), a DNA-binding domain (e.g., Cas (e.g., *Staphylococcus aureus* dCas9, *Streptococcus pyogenes* dCas9, *S. aureus* dCas9, dCas12a or dCas12f), ZFP or TALE), and a DNMT3 methyltransferase-binding domain (e.g., a Dnmt3L C-terminal domain).

In some embodiments, a fusion protein comprises, from N-terminus to C-terminus, a H3K4me0 (e.g., a 12-aa or a 30-aa N-terminal fragment of SEQ ID NO:393, 394, 395 or 396, such as the sequence set forth in SEQ ID NO:81 or 87), a DNA-binding domain (e.g., Cas (e.g., *Staphylococcus aureus* dCas9, *Streptococcus pyogenes* dCas9, *S. aureus* dCas9, dCas12a or dCas12f), ZFP or TALE), and a Dnmt3L (e.g., *Mus musculus* or *Apodemus sylvaticus* DNMT3L) C-terminal domain.

In some embodiments, a fusion protein comprises, from N-terminus to C-terminus, a H3K4me0 (e.g., a 12-aa or a 30-aa N-terminal fragment of SEQ ID NO:393, 394, 395 or 396, such as the sequence set forth in SEQ ID NO:81 or 87), a Cas (e.g., *Staphylococcus aureus* dCas9, *Streptococcus pyogenes* dCas9, *S. aureus* dCas9, dCas12a or dCas12f), and a DNMT3 methyltransferase-binding domain (e.g., a Dnmt3L C-terminal domain).

In some embodiments, a fusion protein comprises, from N-terminus to C-terminus, a H3K4me0 (e.g., a 12-aa or a 30-aa N-terminal fragment of SEQ ID NO:393, 394, 395 or 396, such as the sequence set forth in SEQ ID NO:81 or 87), a Cas (e.g., *Staphylococcus aureus* dCas9, *Streptococcus pyogenes* dCas9, *S. aureus* dCas9, dCas12a or dCas12f), and a Dnmt3L (e.g., *Mus musculus* or *Apodemus sylvaticus* DNMT3L) C-terminal domain.

In some embodiments, a fusion protein comprises, from N-terminus to C-terminus, a H3K4me0 (e.g., a 12-aa or a 30-aa N-terminal fragment of SEQ ID NO:393, 394, 395 or 396, such as the sequence set forth in SEQ ID NO:81 or 87), a ZFP, and a DNMT3 methyltransferase-binding domain (e.g., a Dnmt3L C-terminal domain).

In some embodiments, a fusion protein comprises, from N-terminus to C-terminus, a H3K4me0 (e.g., a 12-aa or a 30-aa N-terminal fragment of SEQ ID NO:393, 394, 395 or 396, such as the sequence set forth in SEQ ID NO:81 or 87), a ZFP, and a Dnmt3L (e.g., *Mus musculus* or *Apodemus sylvaticus* DNMT3L) C-terminal domain.

In some embodiments, a fusion protein comprises, from N-terminus to C-terminus, a H3K4me0 (e.g., a 12-aa or a 30-aa N-terminal fragment of SEQ ID NO:393, 394, 395 or 396, such as the sequence set forth in SEQ ID NO:81 or 87), a TALE, and a DNMT3 methyltransferase-binding domain (e.g., a Dnmt3L C-terminal domain).

In some embodiments, a fusion protein comprises, from N-terminus to C-terminus, a H3K4me0 (e.g., a 12-aa or a 30-aa N-terminal fragment of SEQ ID NO:393, 394, 395 or 396, such as the sequence set forth in SEQ ID NO:81 or 87), a TALE, and a Dnmt3L (e.g., *Mus musculus* or *Apodemus sylvaticus* DNMT3L) C-terminal domain.

In some embodiments, a fusion protein comprises, from N-terminus to C-terminus, a DNA-binding domain (e.g., Cas (e.g., *Staphylococcus aureus* dCas9, *Streptococcus pyogenes* dCas9, *S. aureus* dCas9, dCas12a or dCas12f), ZFP or TALE), a DNMT3 methyltransferase-binding domain (e.g., a Dnmt3L C-terminal domain), and a H3K4me0 (e.g., a 12-aa or a 30-aa N-terminal fragment of SEQ ID NO:393, 394, 395 or 396, such as the sequence set forth in SEQ ID NO:81 or 87).

In some embodiments, a fusion protein comprises, from N-terminus to C-terminus, a DNA-binding domain (e.g., Cas (e.g., *Staphylococcus aureus* dCas9, *Streptococcus pyogenes* dCas9, *S. aureus* dCas9, dCas12a or dCas12f), ZFP or TALE), a Dnmt3L (e.g., *Mus musculus* or *Apodemus sylvaticus* DNMT3L) C-terminal domain, and a H3K4me0 (e.g., a 12-aa or a 30-aa N-terminal fragment of SEQ ID NO:393, 394, 395 or 396, such as the sequence set forth in SEQ ID NO:81 or 87).

In some embodiments, a fusion protein comprises, from N-terminus to C-terminus, a Cas (e.g., *Staphylococcus aureus* dCas9, *Streptococcus pyogenes* dCas9, *S. aureus* dCas9, dCas12a or dCas12f), a DNMT3 methyltransferase-binding domain (e.g., a Dnmt3L C-terminal domain), and a H3K4me0 (e.g., a 12-aa or a 30-aa N-terminal fragment of SEQ ID NO:393, 394, 395 or 396, such as the sequence set forth in SEQ ID NO:81 or 87).

In some embodiments, a fusion protein comprises, from N-terminus to C-terminus, a Cas (e.g., *Staphylococcus aureus* dCas9, *Streptococcus pyogenes* dCas9, *S. aureus* dCas9, dCas12a or dCas12f), a Dnmt3L (e.g., *Mus musculus* or *Apodemus sylvaticus* DNMT3L) C-terminal domain, and a H3K4me0 (e.g., a 12-aa or a 30-aa N-terminal fragment of SEQ ID NO:393, 394, 395 or 396, such as the sequence set forth in SEQ ID NO:81 or 87).

In some embodiments, a fusion protein comprises, from N-terminus to C-terminus, a ZFP, a DNMT3 methyltransferase-binding domain (e.g., a Dnmt3L C-terminal domain), and a H3K4me0 (e.g., a 12-aa or a 30-aa N-terminal fragment of SEQ ID NO:393, 394, 395 or 396, such as the sequence set forth in SEQ ID NO:81 or 87).

In some embodiments, a fusion protein comprises, from N-terminus to C-terminus, a ZFP, a Dnmt3L (e.g., *Mus musculus* or *Apodemus sylvaticus* DNMT3L) C-terminal domain, and a H3K4me0 (e.g., a 12-aa or a 30-aa N-terminal fragment of SEQ ID NO:393, 394, 395 or 396, such as the sequence set forth in SEQ ID NO:81 or 87).

In some embodiments, a fusion protein comprises, from N-terminus to C-terminus, a TALE, a DNMT3 methyltransferase-binding domain (e.g., a Dnmt3L C-terminal domain), and a H3K4me0 (e.g., a 12-aa or a 30-aa N-terminal fragment of SEQ ID NO:393, 394, 395 or 396, such as the sequence set forth in SEQ ID NO:81 or 87).

In some embodiments, a fusion protein comprises, from N-terminus to C-terminus, a TALE, a Dnmt3L (e.g., *Mus musculus* or *Apodemus sylvaticus* DNMT3L) C-terminal domain, and a H3K4me0 (e.g., a 12-aa or a 30-aa N-terminal fragment of SEQ ID NO:393, 394, 395 or 396, such as the sequence set forth in SEQ ID NO:81 or 87).

In some embodiments, a fusion protein comprises, from N-terminus to C-terminus, a DNMT3 methyltransferase-binding domain (e.g., a Dnmt3L C-terminal domain), a DNA-binding domain (e.g., Cas (e.g., *Staphylococcus aureus* dCas9, *Streptococcus pyogenes* dCas9, *S. aureus* dCas9, dCas12a or dCas12f), ZFP or TALE), and a H3K4me0 (e.g., a 12-aa or a 30-aa N-terminal fragment of SEQ ID NO:393, 394, 395 or 396, such as the sequence set forth in SEQ ID NO:81 or 87).

In some embodiments, a fusion protein comprises, from N-terminus to C-terminus, a Dnmt3L (e.g., *Mus musculus* or *Apodemus sylvaticus* DNMT3L) C-terminal domain, a DNA-binding domain (e.g., Cas (e.g., *Staphylococcus aureus* dCas9, *Streptococcus pyogenes* dCas9, *S. aureus* dCas9, dCas12a or dCas12f), ZFP or TALE), and a H3K4me0 (e.g., a 12-aa or a 30-aa N-terminal fragment of SEQ ID NO:393, 394, 395 or 396, such as the sequence set forth in SEQ ID NO:81 or 87).

In some embodiments, a fusion protein comprises, from N-terminus to C-terminus, a DNMT3 methyltransferase-binding domain (e.g., a Dnmt3L C-terminal domain), a Cas (e.g., *Staphylococcus aureus* dCas9, *Streptococcus pyogenes* dCas9, *S. aureus* dCas9, dCas12a or dCas12f), and a H3K4me0 (e.g., a 12-aa or a 30-aa N-terminal fragment of SEQ ID NO:393, 394, 395 or 396, such as the sequence set forth in SEQ ID NO:81 or 87).

In some embodiments, a fusion protein comprises, from N-terminus to C-terminus, a Dnmt3L (e.g., *Mus musculus* or *Apodemus sylvaticus* DNMT3L) C-terminal domain, a Cas (e.g., *Staphylococcus aureus* dCas9, *Streptococcus pyogenes* dCas9, *S. aureus* dCas9, dCas12a or dCas12f), and a H3K4me0 (e.g., a 12-aa or a 30-aa N-terminal fragment of SEQ ID NO:393, 394, 395 or 396, such as the sequence set forth in SEQ ID NO:81 or 87).

In some embodiments, a fusion protein comprises, from N-terminus to C-terminus, a DNMT3 methyltransferase-binding domain (e.g., a Dnmt3L C-terminal domain), a ZFP, and a H3K4me0 (e.g., a 12-aa or a 30-aa N-terminal fragment of SEQ ID NO:393, 394, 395 or 396, such as the sequence set forth in SEQ ID NO:81 or 87).

In some embodiments, a fusion protein comprises, from N-terminus to C-terminus, a Dnmt3L (e.g., *Mus musculus* or *Apodemus sylvaticus* DNMT3L) C-terminal domain, a ZFP, and a H3K4me0 (e.g., a 12-aa or a 30-aa N-terminal fragment of SEQ ID NO:393, 394, 395 or 396, such as the sequence set forth in SEQ ID NO:81 or 87).

In some embodiments, a fusion protein comprises, from N-terminus to C-terminus, a DNMT3 methyltransferase-binding domain (e.g., a Dnmt3L C-terminal domain), a TALE, and a H3K4me0 (e.g., a 12-aa or a 30-aa N-terminal fragment of SEQ ID NO:393, 394, 395 or 396, such as the sequence set forth in SEQ ID NO:81 or 87).

In some embodiments, a fusion protein comprises, from N-terminus to C-terminus, a Dnmt3L (e.g., *Mus musculus* or *Apodemus sylvaticus* DNMT3L) C-terminal domain, and a H3K4me0 (e.g., a 12-aa or a 30-aa N-terminal fragment of SEQ ID NO:393, 394, 395 or 396, such as the sequence set forth in SEQ ID NO:81 or 87).

In some embodiments, a fusion protein comprises, from N-terminus to C-terminus, a DNMT3 methyltransferase-binding domain (e.g., a Dnmt3L C-terminal domain), a H3K4me0 (e.g., a 12-aa or a 30-aa N-terminal fragment of SEQ ID NO:393, 394, 395 or 396, such as the sequence set forth in SEQ ID NO:81 or 87), and a DNA-binding domain (e.g., Cas (e.g., *Staphylococcus aureus* dCas9, *Streptococcus pyogenes* dCas9, *S. aureus* dCas9, dCas12a or dCas12f), ZFP or TALE).

In some embodiments, a fusion protein comprises, from N-terminus to C-terminus, a Dnmt3L (e.g., *Mus musculus* or *Apodemus sylvaticus* DNMT3L) C-terminal domain, a H3K4me0 (e.g., a 12-aa or a 30-aa N-terminal fragment of SEQ ID NO:393, 394, 395 or 396, such as the sequence set forth in SEQ ID NO:81 or 87), and a DNA-binding domain (e.g., Cas (e.g., *Staphylococcus aureus* dCas9, *Streptococcus pyogenes* dCas9, *S. aureus* dCas9, dCas12a or dCas12f), ZFP or TALE).

In some embodiments, a fusion protein comprises, from N-terminus to C-terminus, a DNMT3 methyltransferase-binding domain (e.g., a Dnmt3L C-terminal domain), a H3K4me0 (e.g., a 12-aa or a 30-aa N-terminal fragment of SEQ ID NO:393, 394, 395 or 396, such as the sequence set forth in SEQ ID NO:81 or 87), and a Cas (e.g., *Staphylococcus aureus* dCas9, *Streptococcus pyogenes* dCas9, *S. aureus* dCas9, dCas12a or dCas12f).

In some embodiments, a fusion protein comprises, from N-terminus to C-terminus, a Dnmt3L (e.g., *Mus musculus* or *Apodemus sylvaticus* DNMT3L) C-terminal domain, a H3K4me0 (e.g., a 12-aa or a 30-aa N-terminal fragment of SEQ ID NO:393, 394, 395 or 396, such as the sequence set forth in SEQ ID NO:81 or 87), and a Cas (e.g., *Staphylococcus aureus* dCas9, *Streptococcus pyogenes* dCas9, *S. aureus* dCas9, dCas12a or dCas12f).

In some embodiments, a fusion protein comprises, from N-terminus to C-terminus, a DNMT3 methyltransferase-binding domain (e.g., a Dnmt3L C-terminal domain), a H3K4me0 (e.g., a 12-aa or a 30-aa N-terminal fragment of SEQ ID NO:393, 394, 395 or 396, such as the sequence set forth in SEQ ID NO:81 or 87), and a ZFP.

In some embodiments, a fusion protein comprises, from N-terminus to C-terminus, a Dnmt3L (e.g., *Mus musculus* or *Apodemus sylvaticus* DNMT3L) C-terminal domain, a H3K4me0 (e.g., a 12-aa or a 30-aa N-terminal fragment of SEQ ID NO:393, 394, 395 or 396, such as the sequence set forth in SEQ ID NO:81 or 87), and a ZFP.

In some embodiments, a fusion protein comprises, from N-terminus to C-terminus, a DNMT3 methyltransferase-binding domain (e.g., a Dnmt3L C-terminal domain), a H3K4me0 (e.g., a 12-aa or a 30-aa N-terminal fragment of SEQ ID NO:393, 394, 395 or 396, such as the sequence set forth in SEQ ID NO:81 or 87), and a TALE.

In some embodiments, a fusion protein comprises, from N-terminus to C-terminus, a Dnmt3L (e.g., *Mus musculus* or *Apodemus sylvaticus* DNMT3L) C-terminal domain, a H3K4me0 (e.g., a 12-aa or a 30-aa N-terminal fragment of SEQ ID NO:393, 394, 395 or 396, such as the sequence set forth in SEQ ID NO:81 or 87), and a TALE.

In some embodiments, a fusion protein comprises, from N-terminus to C-terminus, a DNA-binding domain (e.g., Cas (e.g., *Staphylococcus aureus* dCas9, *Streptococcus pyogenes* dCas9, *S. aureus* dCas9, dCas12a or dCas12f), ZFP or TALE), a H3K4me0 (e.g., a 12-aa or a 30-aa N-terminal fragment of SEQ ID NO:393, 394, 395 or 396, such as the sequence set forth in SEQ ID NO:81 or 87), and a DNMT3 methyltransferase-binding domain (e.g., a Dnmt3L C-terminal domain).

In some embodiments, a fusion protein comprises, from N-terminus to C-terminus, a DNA-binding domain (e.g., Cas (e.g., *Staphylococcus aureus* dCas9, *Streptococcus pyogenes* dCas9, *S. aureus* dCas9, dCas12a or dCas12f), ZFP or TALE), a H3K4me0 (e.g., a 12-aa or a 30-aa N-terminal fragment of SEQ ID NO:393, 394, 395 or 396, such as the sequence set forth in SEQ ID NO:81 or 87), and a Dnmt3L (e.g., *Mus musculus* or *Apodemus sylvaticus* DNMT3L) C-terminal domain.

In some embodiments, a fusion protein comprises, from N-terminus to C-terminus, a Cas (e.g., *Staphylococcus aureus* dCas9, *Streptococcus pyogenes* dCas9, *S. aureus* dCas9, dCas12a or dCas12f), a H3K4me0 (e.g., a 12-aa or a 30-aa N-terminal fragment of SEQ ID NO:393, 394, 395 or 396, such as the sequence set forth in SEQ ID NO:81 or 87), and a DNMT3 methyltransferase-binding domain (e.g., a Dnmt3L C-terminal domain).

In some embodiments, a fusion protein comprises, from N-terminus to C-terminus, a Cas (e.g., *Staphylococcus aureus* dCas9, *Streptococcus pyogenes* dCas9, *S. aureus* dCas9, dCas12a or dCas12f), a H3K4me0 (e.g., a 12-aa or a 30-aa N-terminal fragment of SEQ ID NO:393, 394, 395 or 396, such as the sequence set forth in SEQ ID NO:81 or 87), and a Dnmt3L (e.g., *Mus musculus* or *Apodemus sylvaticus* DNMT3L) C-terminal domain.

In some embodiments, a fusion protein comprises, from N-terminus to C-terminus, a ZFP, a H3K4me0 (e.g., a 12-aa or a 30-aa N-terminal fragment of SEQ ID NO:393, 394, 395 or 396, such as the sequence set forth in SEQ ID NO:81 or 87), and a DNMT3 methyltransferase-binding domain (e.g., a Dnmt3L C-terminal domain).

In some embodiments, a fusion protein comprises, from N-terminus to C-terminus, a ZFP, a H3K4me0 (e.g., a 12-aa or a 30-aa N-terminal fragment of SEQ ID NO:393, 394, 395 or 396, such as the sequence set forth in SEQ ID NO:81 or 87), and a Dnmt3L (e.g., *Mus musculus* or *Apodemus sylvaticus* DNMT3L) C-terminal domain.

In some embodiments, a fusion protein comprises, from N-terminus to C-terminus, a TALE, a H3K4me0 (e.g., a 12-aa or a 30-aa N-terminal fragment of SEQ ID NO:393, 394, 395 or 396, such as the sequence set forth in SEQ ID NO:81 or 87), and a DNMT3 methyltransferase-binding domain (e.g., a Dnmt3L C-terminal domain).

In some embodiments, a fusion protein comprises, from N-terminus to C-terminus, a TALE, a H3K4me0 (e.g., a 12-aa or a 30-aa N-terminal fragment of SEQ ID NO:393, 394, 395 or 396, such as the sequence set forth in SEQ ID NO:81 or 87), and a Dnmt3L (e.g., *Mus musculus* or *Apodemus sylvaticus* DNMT3L) C-terminal domain.

With a KRAB Domain

In some embodiments, a fusion protein comprises, from N-terminus to C-terminus:

a) a H3K4me0 (e.g., a 12-aa or a 30-aa N-terminal fragment of SEQ ID NO:393, 394, 395 or 396, such as the sequence set forth in SEQ ID NO:81 or 87), a DNMT3 methyltransferase-binding domain (e.g., a Dnmt3L C-terminal domain), a DNA-binding domain (e.g., Cas (e.g., a *Staphylococcus aureus* dCas9, a *Streptococcus pyogenes* dCas9, a *S. aureus* dCas9 or a Cas12a), ZFP or TALE), and a KRAB domain (e.g., KOX1 or ZIM3 KRAB domain);

b) a H3K4me0 (e.g., a 12-aa or a 30-aa N-terminal fragment of SEQ ID NO:393, 394, 395 or 396, such as the sequence set forth in SEQ ID NO:81 or 87), a DNA-binding domain (e.g., Cas (e.g., *Staphylococcus aureus* dCas9, *Streptococcus pyogenes* dCas9, *S. aureus* dCas9, dCas12a or dCas12f), ZFP or TALE), a DNMT3 methyltransferase-binding domain (e.g., a Dnmt3L C-terminal domain), and a KRAB domain (e.g., KOX1 or ZIM3 KRAB domain);

c) a DNA-binding domain (e.g., Cas (e.g., *Staphylococcus aureus* dCas9, *Streptococcus pyogenes* dCas9, *S. aureus* dCas9, dCas12a or dCas12f), ZFP or TALE), a DNMT3 methyltransferase-binding domain (e.g., a Dnmt3L C-terminal domain), a H3K4me0 (e.g., a 12-aa or a 30-aa N-terminal fragment of SEQ ID NO:393, 394, 395 or 396, such as the sequence set forth in SEQ ID NO:81 or 87), and a KRAB domain (e.g., KOX1 or ZIM3 KRAB domain);

d) a DNMT3 methyltransferase-binding domain (e.g., a Dnmt3L C-terminal domain), a DNA-binding domain (e.g., Cas (e.g., *Staphylococcus aureus* dCas9, *Streptococcus pyogenes* dCas9, *S. aureus* dCas9, dCas12a or dCas12f), ZFP or TALE), a H3K4me0 (e.g., a 12-aa or a 30-aa N-terminal fragment of SEQ ID NO:393, 394, 395 or 396, such as the sequence set forth in SEQ ID NO:81 or 87), and a KRAB domain (e.g., KOX1 or ZIM3 KRAB domain);

e) a DNMT3 methyltransferase-binding domain (e.g., a Dnmt3L C-terminal domain), a H3K4me0 (e.g., a 12-aa or a 30-aa N-terminal fragment of SEQ ID NO:393, 394, 395 or 396, such as the sequence set forth in SEQ ID NO:81 or 87), a DNA-binding domain (e.g., Cas (e.g., *Staphylococcus aureus* dCas9, *Streptococcus pyogenes* dCas9, *S. aureus* dCas9, dCas12a or dCas12f), ZFP or TALE), and a KRAB domain (e.g., KOX1 or ZIM3 KRAB domain); or f) a DNA-binding domain (e.g., Cas (e.g., *Staphylococcus aureus* dCas9, *Streptococcus pyogenes* dCas9, *S. aureus* dCas9, dCas12a or dCas12f), ZFP or TALE), a H3K4me0 (e.g., a 12-aa or a 30-aa N-terminal fragment of SEQ ID NO:393, 394, 395 or 396, such as the sequence set forth in SEQ ID NO:81 or 87), a DNMT3 methyltransferase-binding domain (e.g., a Dnmt3L C-terminal domain), and a KRAB domain (e.g., KOX1 or ZIM3 KRAB domain).

In some embodiments, a fusion protein comprises, from N-terminus to C-terminus:

a) a H3K4me0 (e.g., a 12-aa or a 30-aa N-terminal fragment of SEQ ID NO:393, 394, 395 or 396, such as the sequence set forth in SEQ ID NO:81 or 87), a Dnmt3L (e.g., *Mus musculus* or *Apodemus sylvaticus* DNMT3L) C-terminal domain, a DNA-binding domain (e.g., Cas (e.g., *Staphylococcus aureus* dCas9, *Streptococcus pyogenes* dCas9, *S. aureus* dCas9, dCas12a or dCas12f), ZFP or TALE), and a KRAB domain (e.g., KOX1 or ZIM3 KRAB domain);

b) a H3K4me0 (e.g., a 12-aa or a 30-aa N-terminal fragment of SEQ ID NO:393, 394, 395 or 396, such as the sequence set forth in SEQ ID NO:81 or 87), a DNA-binding domain (e.g., Cas (e.g., *Staphylococcus aureus* dCas9, *Streptococcus pyogenes* dCas9, *S. aureus* dCas9, dCas12a or dCas12f), ZFP or TALE), a Dnmt3L (e.g., *Mus musculus* or *Apodemus sylvaticus* DNMT3L) C-terminal domain, and a KRAB domain (e.g., KOX1 or ZIM3 KRAB domain);

c) a DNA-binding domain (e.g., Cas (e.g., *Staphylococcus aureus* dCas9, *Streptococcus pyogenes* dCas9, *S. aureus* dCas9, dCas12a or dCas12f), ZFP or TALE), a Dnmt3L (e.g., *Mus musculus* or *Apodemus sylvaticus* DNMT3L) C-terminal domain, a H3K4me0 (e.g., a 12-aa or a 30-aa N-terminal fragment of SEQ ID NO:393, 394, 395 or 396, such as the sequence set forth in SEQ ID NO:81 or 87), and a KRAB domain (e.g., KOX1 or ZIM3 KRAB domain);

d) a Dnmt3L (e.g., *Mus musculus* or *Apodemus sylvaticus* DNMT3L) C-terminal domain, a DNA-binding domain (e.g., Cas (e.g., *Staphylococcus aureus* dCas9, *Streptococcus pyogenes* dCas9, *S. aureus* dCas9, dCas12a or dCas12f), ZFP or TALE), a H3K4me0 (e.g., a 12-aa or a 30-aa N-terminal fragment of SEQ ID NO:393, 394, 395 or 396, such as the sequence set forth in SEQ ID NO:81 or 87), and a KRAB domain (e.g., KOX1 or ZIM3 KRAB domain);

e) a Dnmt3L (e.g., *Mus musculus* or *Apodemus sylvaticus* DNMT3L) C-terminal domain, a H3K4me0 (e.g., a 12-aa or a 30-aa N-terminal fragment of SEQ ID NO:393, 394, 395 or 396, such as the sequence set forth in SEQ ID NO:81 or 87), a DNA-binding domain (e.g., Cas (e.g., *Staphylococcus aureus* dCas9, *Streptococcus pyogenes* dCas9, *S. aureus* dCas9, dCas12a or dCas12f), ZFP or TALE), and a KRAB domain (e.g., KOX1 or ZIM3 KRAB domain); or f) a DNA-binding domain (e.g., Cas (e.g., *Staphylococcus aureus* dCas9, *Streptococcus pyogenes* dCas9, *S. aureus* dCas9, dCas12a or dCas12f), ZFP or TALE), a H3K4me0 (e.g., a 12-aa or a 30-aa N-terminal fragment of SEQ ID NO:393, 394, 395 or 396, such as the sequence set forth in SEQ ID NO:81 or 87), a Dnmt3L (e.g., *Mus musculus* or *Apodemus sylvaticus* DNMT3L) C-terminal domain, and a KRAB domain (e.g., KOX1 or ZIM3 KRAB domain).

In some embodiments, a fusion protein comprises, from N-terminus to C-terminus:

a) a H3K4me0 (e.g., a 12-aa or a 30-aa N-terminal fragment of SEQ ID NO:393, 394, 395 or 396, such as the sequence set forth in SEQ ID NO:81 or 87), a DNMT3 methyltransferase-binding domain (e.g., a Dnmt3L C-terminal domain), a Cas (e.g., *Staphylococcus aureus* dCas9, *Streptococcus pyogenes* dCas9, *S. aureus* dCas9, dCas12a or dCas12f), and a KRAB domain (e.g., KOX1 or ZIM3 KRAB domain);

b) a H3K4me0 (e.g., a 12-aa or a 30-aa N-terminal fragment of SEQ ID NO:393, 394, 395 or 396, such as the sequence set forth in SEQ ID NO:81 or 87), a Cas (e.g., *Staphylococcus aureus* dCas9, *Streptococcus pyogenes* dCas9, *S. aureus* dCas9, dCas12a or dCas12f), a DNMT3 methyltransferase-binding domain (e.g., a Dnmt3L C-terminal domain), and a KRAB domain (e.g., KOX1 or ZIM3 KRAB domain);

c) a Cas (e.g., *Staphylococcus aureus* dCas9, *Streptococcus pyogenes* dCas9, *S. aureus* dCas9, dCas12a or dCas12f), a DNMT3 methyltransferase-binding domain (e.g., a Dnmt3L C-terminal domain), a H3K4me0 (e.g., a 12-aa or a 30-aa N-terminal fragment of SEQ ID NO:393, 394, 395 or 396, such as the sequence set forth in SEQ ID NO:81 or 87), and a KRAB domain (e.g., KOX1 or ZIM3 KRAB domain);

d) a DNMT3 methyltransferase-binding domain (e.g., a Dnmt3L C-terminal domain), a Cas (e.g., *Staphylococcus aureus* dCas9, *Streptococcus pyogenes* dCas9, *S. aureus* dCas9, dCas12a or dCas12f), a H3K4me0 (e.g., a 12-aa or a 30-aa N-terminal fragment of SEQ ID NO:393, 394, 395 or 396, such as the sequence set forth in SEQ ID NO:81 or 87), and a KRAB domain (e.g., KOX1 or ZIM3 KRAB domain);

e) a DNMT3 methyltransferase-binding domain (e.g., a Dnmt3L C-terminal domain), a H3K4me0 (e.g., a 12-aa or a 30-aa N-terminal fragment of SEQ ID NO:393, 394, 395 or 396, such as the sequence set forth in SEQ ID NO:81 or 87), a Cas (e.g., *Staphylococcus aureus* dCas9, *Streptococcus pyogenes* dCas9, *S. aureus* dCas9, dCas12a or dCas12f), and a KRAB domain (e.g., KOX1 or ZIM3 KRAB domain); or f) a Cas (e.g., *Staphylococcus aureus* dCas9, *Streptococcus pyogenes* dCas9, *S. aureus* dCas9, dCas12a or dCas12f), a H3K4me0 (e.g., a 12-aa or a 30-aa N-terminal fragment of SEQ ID NO:393, 394, 395 or 396, such as the sequence set forth in SEQ ID NO:81 or 87), a DNMT3 methyltransferase-binding domain (e.g., a Dnmt3L C-terminal domain), and a KRAB domain (e.g., KOX1 or ZIM3 KRAB domain).

In some embodiments, a fusion protein comprises, from N-terminus to C-terminus:

a) a H3K4me0 (e.g., a 12-aa or a 30-aa N-terminal fragment of SEQ ID NO:393, 394, 395 or 396, such as the sequence set forth in SEQ ID NO:81 or 87), a Dnmt3L (e.g., *Mus musculus* or *Apodemus sylvaticus* DNMT3L) C-terminal domain, a Cas (e.g., *Staphylococcus aureus* dCas9, *Streptococcus pyogenes* dCas9, *S. aureus* dCas9, dCas12a or dCas12f), and a KRAB domain (e.g., KOX1 or ZIM3 KRAB domain);

b) a H3K4me0 (e.g., a 12-aa or a 30-aa N-terminal fragment of SEQ ID NO:393, 394, 395 or 396, such as the sequence set forth in SEQ ID NO:81 or 87), a Cas (e.g., *Staphylococcus aureus* dCas9, *Streptococcus pyogenes* dCas9, *S. aureus* dCas9, dCas12a or dCas12f), a Dnmt3L (e.g., *Mus musculus* or *Apodemus sylvaticus* DNMT3L) C-terminal domain, and a KRAB domain (e.g., KOX1 or ZIM3 KRAB domain);

c) a Cas (e.g., *Staphylococcus aureus* dCas9, *Streptococcus pyogenes* dCas9, *S. aureus* dCas9, dCas12a or dCas12f), a Dnmt3L (e.g., *Mus musculus* or *Apodemus sylvaticus* DNMT3L) C-terminal domain, a H3K4me0 (e.g., a 12-aa or a 30-aa N-terminal fragment of SEQ ID NO:393, 394, 395 or 396, such as the sequence set forth in SEQ ID NO:81 or 87), and a KRAB domain (e.g., KOX1 or ZIM3 KRAB domain);

d) a Dnmt3L (e.g., *Mus musculus* or *Apodemus sylvaticus* DNMT3L) C-terminal domain, a Cas (e.g., *Staphylococcus aureus* dCas9, *Streptococcus pyogenes* dCas9, *S. aureus* dCas9, dCas12a or dCas12f), a H3K4me0 (e.g., a 12-aa or a 30-aa N-terminal fragment of SEQ ID NO:393, 394, 395 or 396, such as the sequence set forth in SEQ ID NO:81 or 87), and a KRAB domain (e.g., KOX1 or ZIM3 KRAB domain);

e) a Dnmt3L (e.g., *Mus musculus* or *Apodemus sylvaticus* DNMT3L) C-terminal domain, a H3K4me0 (e.g., a 12-aa or a 30-aa N-terminal fragment of SEQ ID NO:393, 394, 395 or 396, such as the sequence set forth in SEQ ID NO:81 or 87), a Cas (e.g., *Staphylococcus aureus* dCas9, *Streptococcus pyogenes* dCas9, *S. aureus* dCas9, dCas12a or dCas12f), and a KRAB domain (e.g., KOX1 or ZIM3 KRAB domain); or f) a Cas (e.g., *Staphylococcus aureus* dCas9, *Streptococcus pyogenes* dCas9, *S. aureus* dCas9, dCas12a or dCas12f), a H3K4me0 (e.g., a 12-aa or a 30-aa N-terminal fragment of SEQ ID NO:393, 394, 395 or 396, such as the sequence set forth in SEQ ID NO:81 or 87), a Dnmt3L (e.g., *Mus musculus* or *Apodemus sylvaticus* DNMT3L) C-terminal domain, and a KRAB domain (e.g., KOX1 or ZIM3 KRAB domain).

In some embodiments, a fusion protein comprises, from N-terminus to C-terminus:

a) a H3K4me0 (e.g., a 12-aa or a 30-aa N-terminal fragment of SEQ ID NO:393, 394, 395 or 396, such as the sequence set forth in SEQ ID NO:81 or 87), a DNMT3 methyltransferase-binding domain (e.g., a Dnmt3L C-terminal domain), a ZFP, and a KRAB domain (e.g., KOX1 or ZIM3 KRAB domain);

b) a H3K4me0 (e.g., a 12-aa or a 30-aa N-terminal fragment of SEQ ID NO:393, 394, 395 or 396, such as the sequence set forth in SEQ ID NO:81 or 87), a ZFP, a DNMT3 methyltransferase-binding domain (e.g., a Dnmt3L C-terminal domain), and a KRAB domain (e.g., KOX1 or ZIM3 KRAB domain);

c) a ZFP, a DNMT3 methyltransferase-binding domain (e.g., a Dnmt3L C-terminal domain), a H3K4me0 (e.g., a 12-aa or a 30-aa N-terminal fragment of SEQ ID NO:393, 394, 395 or 396, such as the sequence set forth in SEQ ID NO:81 or 87), and a KRAB domain (e.g., KOX1 or ZIM3 KRAB domain);

d) a DNMT3 methyltransferase-binding domain (e.g., a Dnmt3L C-terminal domain), a ZFP, a H3K4me0 (e.g., a 12-aa or a 30-aa N-terminal fragment of SEQ ID NO:393, 394, 395 or 396, such as the sequence set forth in SEQ ID NO:81 or 87), and a KRAB domain (e.g., KOX1 or ZIM3 KRAB domain);

e) a DNMT3 methyltransferase-binding domain (e.g., a Dnmt3L C-terminal domain), a H3K4me0 (e.g., a 12-aa or a 30-aa N-terminal fragment of SEQ ID NO:393, 394, 395 or 396, such as the sequence set forth in SEQ ID NO:81 or 87), a ZFP, and a KRAB domain (e.g., KOX1 or ZIM3 KRAB domain); or f) a ZFP, a H3K4me0 (e.g., a 12-aa or a 30-aa N-terminal fragment of SEQ ID NO:393, 394, 395 or 396, such as the sequence set forth in SEQ ID NO:81 or 87), a DNMT3 methyltransferase-binding domain (e.g., a Dnmt3L C-terminal domain), and a KRAB domain (e.g., KOX1 or ZIM3 KRAB domain).

In some embodiments, a fusion protein comprises, from N-terminus to C-terminus:

a) a H3K4me0 (e.g., a 12-aa or a 30-aa N-terminal fragment of SEQ ID NO:393, 394, 395 or 396, such as the sequence set forth in SEQ ID NO:81 or 87), a Dnmt3L (e.g., *Mus musculus* or *Apodemus sylvaticus* DNMT3L) C-terminal domain, a ZFP, and a KRAB domain (e.g., KOX1 or ZIM3 KRAB domain);

b) a H3K4me0 (e.g., a 12-aa or a 30-aa N-terminal fragment of SEQ ID NO:393, 394, 395 or 396, such as the sequence set forth in SEQ ID NO:81 or 87), a ZFP, a Dnmt3L (e.g., *Mus musculus* or *Apodemus sylvaticus* DNMT3L) C-terminal domain, and a KRAB domain (e.g., KOX1 or ZIM3 KRAB domain);

c) a ZFP, a Dnmt3L (e.g., *Mus musculus* or *Apodemus sylvaticus* DNMT3L) C-terminal domain, a H3K4me0 (e.g., a 12-aa or a 30-aa N-terminal fragment of SEQ ID NO:393, 394, 395 or 396, such as the sequence set forth in SEQ ID NO:81 or 87), and a KRAB domain (e.g., KOX1 or ZIM3 KRAB domain);

d) a Dnmt3L (e.g., *Mus musculus* or *Apodemus sylvaticus* DNMT3L) C-terminal domain, a ZFP, a H3K4me0 (e.g., a 12-aa or a 30-aa N-terminal fragment of SEQ ID NO:393, 394, 395 or 396, such as the sequence set forth in SEQ ID NO:81 or 87), and a KRAB domain (e.g., KOX1 or ZIM3 KRAB domain);

e) a Dnmt3L (e.g., *Mus musculus* or *Apodemus sylvaticus* DNMT3L) C-terminal domain, a H3K4me0 (e.g., a 12-aa or a 30-aa N-terminal fragment of SEQ ID NO:393, 394, 395 or 396, such as the sequence set forth in SEQ ID NO:81 or 87), a ZFP, and a KRAB domain (e.g., KOX1 or ZIM3 KRAB domain); or f) a ZFP, a H3K4me0 (e.g., a 12-aa or a 30-aa N-terminal fragment of SEQ ID NO:393, 394, 395 or 396, such as the sequence set forth in SEQ ID NO:81 or 87), a Dnmt3L (e.g., *Mus musculus* or *Apodemus sylvaticus* DNMT3L) C-terminal domain, and a KRAB domain (e.g., KOX1 or ZIM3 KRAB domain).

In some embodiments, a fusion protein comprises, from N-terminus to C-terminus:

a) a H3K4me0 (e.g., a 12-aa or a 30-aa N-terminal fragment of SEQ ID NO:393, 394, 395 or 396, such as the sequence set forth in SEQ ID NO:81 or 87), a DNMT3 methyltransferase-binding domain (e.g., a Dnmt3L C-terminal domain), a TALE, and a KRAB domain (e.g., KOX1 or ZIM3 KRAB domain);

b) a H3K4me0 (e.g., a 12-aa or a 30-aa N-terminal fragment of SEQ ID NO:393, 394, 395 or 396, such as the sequence set forth in SEQ ID NO:81 or 87), a TALE, a DNMT3 methyltransferase-binding domain (e.g., a Dnmt3L C-terminal domain), and a KRAB domain (e.g., KOX1 or ZIM3 KRAB domain);

c) a TALE, a DNMT3 methyltransferase-binding domain (e.g., a Dnmt3L C-terminal domain), a H3K4me0 (e.g., a 12-aa or a 30-aa N-terminal fragment of SEQ ID NO:393, 394, 395 or 396, such as the sequence set forth in SEQ ID NO:81 or 87), and a KRAB domain (e.g., KOX1 or ZIM3 KRAB domain);

d) a DNMT3 methyltransferase-binding domain (e.g., a Dnmt3L C-terminal domain), a TALE, a H3K4me0 (e.g., a 12-aa or a 30-aa N-terminal fragment of SEQ ID NO:393, 394, 395 or 396, such as the sequence set forth in SEQ ID NO:81 or 87), and a KRAB domain (e.g., KOX1 or ZIM3 KRAB domain);

e) a DNMT3 methyltransferase-binding domain (e.g., a Dnmt3L C-terminal domain), a H3K4me0 (e.g., a 12-aa or a 30-aa N-terminal fragment of SEQ ID NO:393, 394, 395 or 396, such as the sequence set forth in SEQ ID NO:81 or 87), a TALE, and a KRAB domain (e.g., KOX1 or ZIM3 KRAB domain); or f) a TALE, a H3K4me0 (e.g., a 12-aa or a 30-aa N-terminal fragment of SEQ ID NO:393, 394, 395 or 396, such as the sequence set forth in SEQ ID NO:81 or 87), a DNMT3 methyltransferase-binding domain (e.g., a Dnmt3L C-terminal domain), and a KRAB domain (e.g., KOX1 or ZIM3 KRAB domain).

In some embodiments, a fusion protein comprises, from N-terminus to C-terminus:

a) a H3K4me0 (e.g., a 12-aa or a 30-aa N-terminal fragment of SEQ ID NO:393, 394, 395 or 396, such as the sequence set forth in SEQ ID NO:81 or 87), a Dnmt3L (e.g., *Mus musculus* or *Apodemus sylvaticus*

DNMT3L) C-terminal domain, a TALE, and a KRAB domain (e.g., KOX1 or ZIM3 KRAB domain);
b) a H3K4me0 (e.g., a 12-aa or a 30-aa N-terminal fragment of SEQ ID NO:393, 394, 395 or 396, such as the sequence set forth in SEQ ID NO:81 or 87), a TALE, a Dnmt3L (e.g., *Mus musculus* or *Apodemus sylvaticus* DNMT3L) C-terminal domain, and a KRAB domain (e.g., KOX1 or ZIM3 KRAB domain);
c) a TALE, a Dnmt3L (e.g., *Mus musculus* or *Apodemus sylvaticus* DNMT3L) C-terminal domain, a H3K4me0 (e.g., a 12-aa or a 30-aa N-terminal fragment of SEQ ID NO:393, 394, 395 or 396, such as the sequence set forth in SEQ ID NO:81 or 87), and a KRAB domain (e.g., KOX1 or ZIM3 KRAB domain);
d) a Dnmt3L (e.g., *Mus musculus* or *Apodemus sylvaticus* DNMT3L) C-terminal domain, a TALE, a H3K4me0 (e.g., a 12-aa or a 30-aa N-terminal fragment of SEQ ID NO:393, 394, 395 or 396, such as the sequence set forth in SEQ ID NO:81 or 87), and a KRAB domain (e.g., KOX1 or ZIM3 KRAB domain);
e) a Dnmt3L (e.g., *Mus musculus* or *Apodemus sylvaticus* DNMT3L) C-terminal domain, a H3K4me0 (e.g., a 12-aa or a 30-aa N-terminal fragment of SEQ ID NO:393, 394, 395 or 396, such as the sequence set forth in SEQ ID NO:81 or 87), a TALE, and a KRAB domain (e.g., KOX1 or ZIM3 KRAB domain); or
f) a TALE, a H3K4me0 (e.g., a 12-aa or a 30-aa N-terminal fragment of SEQ ID NO:393, 394, 395 or 396, such as the sequence set forth in SEQ ID NO:81 or 87), a Dnmt3L (e.g., *Mus musculus* or *Apodemus sylvaticus* DNMT3L) C-terminal domain, and a KRAB domain (e.g., KOX1 or ZIM3 KRAB domain).

In some embodiments, a fusion protein comprises, from N-terminus to C-terminus:
a) a H3K4me0 (e.g., a 12-aa or a 30-aa N-terminal fragment of SEQ ID NO:393, 394, 395 or 396, such as the sequence set forth in SEQ ID NO:81 or 87), a DNMT3 methyltransferase-binding domain (e.g., a Dnmt3L C-terminal domain), a DNA-binding domain (e.g., Cas (e.g., *Staphylococcus aureus* dCas9, *Streptococcus pyogenes* dCas9, *S. aureus* dCas9, dCas12a or dCas12f), ZFP or TALE), and a KRAB domain (e.g., KOX1 or ZIM3 KRAB domain);
b) a H3K4me0 (e.g., a 12-aa or a 30-aa N-terminal fragment of SEQ ID NO:393, 394, 395 or 396, such as the sequence set forth in SEQ ID NO:81 or 87), a DNA-binding domain (e.g., Cas (e.g., *Staphylococcus aureus* dCas9, *Streptococcus pyogenes* dCas9, *S. aureus* dCas9, dCas12a or dCas12f), ZFP or TALE), a DNMT3 methyltransferase-binding domain (e.g., a Dnmt3L C-terminal domain), and a KRAB domain (e.g., KOX1 or ZIM3 KRAB domain);
c) a DNA-binding domain (e.g., Cas (e.g., *Staphylococcus aureus* dCas9, *Streptococcus pyogenes* dCas9, *S. aureus* dCas9, dCas12a or dCas12f), ZFP or TALE), a DNMT3 methyltransferase-binding domain (e.g., a Dnmt3L C-terminal domain), a H3K4me0 (e.g., a 12-aa or a 30-aa N-terminal fragment of SEQ ID NO:393, 394, 395 or 396, such as the sequence set forth in SEQ ID NO:81 or 87), and a KRAB domain (e.g., KOX1 or ZIM3 KRAB domain); or
d) a DNMT3 methyltransferase-binding domain (e.g., a Dnmt3L C-terminal domain), a DNA-binding domain (e.g., Cas (e.g., *Staphylococcus aureus* dCas9, *Streptococcus pyogenes* dCas9, *S. aureus* dCas9, dCas12a or dCas12f), ZFP or TALE), a H3K4me0 (e.g., a 12-aa or a 30-aa N-terminal fragment of SEQ ID NO:393, 394, 395 or 396, such as the sequence set forth in SEQ ID NO:81 or 87), and a KRAB domain (e.g., KOX1 or ZIM3 KRAB domain).

In some embodiments, a fusion protein comprises, from N-terminus to C-terminus:
a) a H3K4me0 (e.g., a 12-aa or a 30-aa N-terminal fragment of SEQ ID NO:393, 394, 395 or 396, such as the sequence set forth in SEQ ID NO:81 or 87), a Dnmt3L (e.g., *Mus musculus* or *Apodemus sylvaticus* DNMT3L) C-terminal domain, a DNA-binding domain (e.g., Cas (e.g., *Staphylococcus aureus* dCas9, *Streptococcus pyogenes* dCas9, *S. aureus* dCas9, dCas12a or dCas12f), ZFP or TALE), and a KRAB domain (e.g., KOX1 or ZIM3 KRAB domain);
b) a H3K4me0 (e.g., a 12-aa or a 30-aa N-terminal fragment of SEQ ID NO:393, 394, 395 or 396, such as the sequence set forth in SEQ ID NO:81 or 87), a DNA-binding domain (e.g., Cas (e.g., *Staphylococcus aureus* dCas9, *Streptococcus pyogenes* dCas9, *S. aureus* dCas9, dCas12a or dCas12f), ZFP or TALE), a Dnmt3L (e.g., *Mus musculus* or *Apodemus sylvaticus* DNMT3L) C-terminal domain, and a KRAB domain (e.g., KOX1 or ZIM3 KRAB domain);
c) a DNA-binding domain (e.g., Cas (e.g., *Staphylococcus aureus* dCas9, *Streptococcus pyogenes* dCas9, *S. aureus* dCas9, dCas12a or dCas12f), ZFP or TALE), a Dnmt3L (e.g., *Mus musculus* or *Apodemus sylvaticus* DNMT3L) C-terminal domain, a H3K4me0 (e.g., a 12-aa or a 30-aa N-terminal fragment of SEQ ID NO:393, 394, 395 or 396, such as the sequence set forth in SEQ ID NO:81 or 87), and a KRAB domain (e.g., KOX1 or ZIM3 KRAB domain); or
d) a Dnmt3L (e.g., *Mus musculus* or *Apodemus sylvaticus* DNMT3L) C-terminal domain, a DNA-binding domain (e.g., Cas (e.g., *Staphylococcus aureus* dCas9, *Streptococcus pyogenes* dCas9, *S. aureus* dCas9, dCas12a or dCas12f), ZFP or TALE), a H3K4me0 (e.g., a 12-aa or a 30-aa N-terminal fragment of SEQ ID NO:393, 394, 395 or 396, such as the sequence set forth in SEQ ID NO:81 or 87), and a KRAB domain (e.g., KOX1 or ZIM3 KRAB domain).

In some embodiments, a fusion protein comprises, from N-terminus to C-terminus:
a) a H3K4me0 (e.g., a 12-aa or a 30-aa N-terminal fragment of SEQ ID NO:393, 394, 395 or 396, such as the sequence set forth in SEQ ID NO:81 or 87), a DNMT3 methyltransferase-binding domain (e.g., a Dnmt3L C-terminal domain), a Cas (e.g., *Staphylococcus aureus* dCas9, *Streptococcus pyogenes* dCas9, *S. aureus* dCas9, dCas12a or dCas12f), and a KRAB domain (e.g., KOX1 or ZIM3 KRAB domain);
b) a H3K4me0 (e.g., a 12-aa or a 30-aa N-terminal fragment of SEQ ID NO:393, 394, 395 or 396, such as the sequence set forth in SEQ ID NO:81 or 87), a Cas (e.g., *Staphylococcus aureus* dCas9, *Streptococcus pyogenes* dCas9, *S. aureus* dCas9, dCas12a or dCas12f), a DNMT3 methyltransferase-binding domain (e.g., a Dnmt3L C-terminal domain), and a KRAB domain (e.g., KOX1 or ZIM3 KRAB domain);
c) a Cas (e.g., *Staphylococcus aureus* dCas9, *Streptococcus pyogenes* dCas9, *S. aureus* dCas9, dCas12a or dCas12f), a DNMT3 methyltransferase-binding domain (e.g., a Dnmt3L C-terminal domain), a H3K4me0 (e.g., a 12-aa or a 30-aa N-terminal fragment of SEQ ID NO:393, 394, 395 or 396, such as the sequence set forth in SEQ ID NO:81 or 87), and a KRAB domain (e.g., KOX1 or ZIM3 KRAB domain); or d) a DNMT3 methyltransferase-binding domain (e.g., a Dnmt3L C-terminal domain), a Cas (e.g., *Staphylococcus aureus* dCas9, *Streptococcus pyogenes* dCas9, *S. aureus* dCas9, dCas12a or dCas12f), a H3K4me0 (e.g., a 12-aa or a 30-aa N-terminal fragment of SEQ ID NO:393, 394, 395 or 396, such as the sequence set forth in SEQ ID NO:81 or 87), and a KRAB domain (e.g., KOX1 or ZIM3 KRAB domain).

In some embodiments, a fusion protein comprises, from N-terminus to C-terminus:

a) a H3K4me0 (e.g., a 12-aa or a 30-aa N-terminal fragment of SEQ ID NO:393, 394, 395 or 396, such as the sequence set forth in SEQ ID NO:81 or 87), a Dnmt3L (e.g., *Mus musculus* or *Apodemus sylvaticus* DNMT3L) C-terminal domain, a Cas (e.g., *Staphylococcus aureus* dCas9, *Streptococcus pyogenes* dCas9, *S. aureus* dCas9, dCas12a or dCas12f), and a KRAB domain (e.g., KOX1 or ZIM3 KRAB domain);

b) a H3K4me0 (e.g., a 12-aa or a 30-aa N-terminal fragment of SEQ ID NO:393, 394, 395 or 396, such as the sequence set forth in SEQ ID NO:81 or 87), a Cas (e.g., *Staphylococcus aureus* dCas9, *Streptococcus pyogenes* dCas9, *S. aureus* dCas9, dCas12a or dCas12f), a Dnmt3L (e.g., *Mus musculus* or *Apodemus sylvaticus* DNMT3L) C-terminal domain, and a KRAB domain (e.g., KOX1 or ZIM3 KRAB domain);

c) a Cas (e.g., *Staphylococcus aureus* dCas9, *Streptococcus pyogenes* dCas9, *S. aureus* dCas9, dCas12a or dCas12f), a Dnmt3L (e.g., *Mus musculus* or *Apodemus sylvaticus* DNMT3L) C-terminal domain, a H3K4me0 (e.g., a 12-aa or a 30-aa N-terminal fragment of SEQ ID NO:393, 394, 395 or 396, such as the sequence set forth in SEQ ID NO:81 or 87), and a KRAB domain (e.g., KOX1 or ZIM3 KRAB domain); or d) a Dnmt3L (e.g., *Mus musculus* or *Apodemus sylvaticus* DNMT3L) C-terminal domain, a Cas (e.g., *Staphylococcus aureus* dCas9, *Streptococcus pyogenes* dCas9, *S. aureus* dCas9, dCas12a or dCas12f), a H3K4me0 (e.g., a 12-aa or a 30-aa N-terminal fragment of SEQ ID NO:393, 394, 395 or 396, such as the sequence set forth in SEQ ID NO:81 or 87), and a KRAB domain (e.g., KOX1 or ZIM3 KRAB domain).

In some embodiments, a fusion protein comprises, from N-terminus to C-terminus:

a) a H3K4me0 (e.g., a 12-aa or a 30-aa N-terminal fragment of SEQ ID NO:393, 394, 395 or 396, such as the sequence set forth in SEQ ID NO:81 or 87), a DNMT3 methyltransferase-binding domain (e.g., a Dnmt3L C-terminal domain), a ZFP, and a KRAB domain (e.g., KOX1 or ZIM3 KRAB domain);

b) a H3K4me0 (e.g., a 12-aa or a 30-aa N-terminal fragment of SEQ ID NO:393, 394, 395 or 396, such as the sequence set forth in SEQ ID NO:81 or 87), a ZFP, a DNMT3 methyltransferase-binding domain (e.g., a Dnmt3L C-terminal domain), and a KRAB domain (e.g., KOX1 or ZIM3 KRAB domain);

c) a ZFP, a DNMT3 methyltransferase-binding domain (e.g., a Dnmt3L C-terminal domain), a H3K4me0 (e.g., a 12-aa or a 30-aa N-terminal fragment of SEQ ID NO:393, 394, 395 or 396, such as the sequence set forth in SEQ ID NO:81 or 87), and a KRAB domain (e.g., KOX1 or ZIM3 KRAB domain); or d) a DNMT3 methyltransferase-binding domain (e.g., a Dnmt3L C-terminal domain), a ZFP, a H3K4me0 (e.g., a 12-aa or a 30-aa N-terminal fragment of SEQ ID NO:393, 394, 395 or 396, such as the sequence set forth in SEQ ID NO:81 or 87), and a KRAB domain (e.g., KOX1 or ZIM3 KRAB domain).

In some embodiments, a fusion protein comprises, from N-terminus to C-terminus:

a) a H3K4me0 (e.g., a 12-aa or a 30-aa N-terminal fragment of SEQ ID NO:393, 394, 395 or 396, such as the sequence set forth in SEQ ID NO:81 or 87), a Dnmt3L (e.g., *Mus musculus* or *Apodemus sylvaticus* DNMT3L) C-terminal domain, a ZFP, and a KRAB domain (e.g., KOX1 or ZIM3 KRAB domain);

b) a H3K4me0 (e.g., a 12-aa or a 30-aa N-terminal fragment of SEQ ID NO:393, 394, 395 or 396, such as the sequence set forth in SEQ ID NO:81 or 87), a ZFP, a Dnmt3L (e.g., *Mus musculus* or *Apodemus sylvaticus* DNMT3L) C-terminal domain, and a KRAB domain (e.g., KOX1 or ZIM3 KRAB domain);

c) a ZFP, a Dnmt3L (e.g., *Mus musculus* or *Apodemus sylvaticus* DNMT3L) C-terminal domain, a H3K4me0 (e.g., a 12-aa or a 30-aa N-terminal fragment of SEQ ID NO:393, 394, 395 or 396, such as the sequence set forth in SEQ ID NO:81 or 87), and a KRAB domain (e.g., KOX1 or ZIM3 KRAB domain); or d) a Dnmt3L (e.g., *Mus musculus* or *Apodemus sylvaticus* DNMT3L) C-terminal domain, a ZFP, a H3K4me0 (e.g., a 12-aa or a 30-aa N-terminal fragment of SEQ ID NO:393, 394, 395 or 396, such as the sequence set forth in SEQ ID NO:81 or 87), and a KRAB domain (e.g., KOX1 or ZIM3 KRAB domain).

In some embodiments, a fusion protein comprises, from N-terminus to C-terminus:

a) a H3K4me0 (e.g., a 12-aa or a 30-aa N-terminal fragment of SEQ ID NO:393, 394, 395 or 396, such as the sequence set forth in SEQ ID NO:81 or 87), a DNMT3 methyltransferase-binding domain (e.g., a Dnmt3L C-terminal domain), a TALE, and a KRAB domain (e.g., KOX1 or ZIM3 KRAB domain);

b) a H3K4me0 (e.g., a 12-aa or a 30-aa N-terminal fragment of SEQ ID NO:393, 394, 395 or 396, such as the sequence set forth in SEQ ID NO:81 or 87), a TALE, a DNMT3 methyltransferase-binding domain (e.g., a Dnmt3L C-terminal domain), and a KRAB domain (e.g., KOX1 or ZIM3 KRAB domain);

c) a TALE, a DNMT3 methyltransferase-binding domain (e.g., a Dnmt3L C-terminal domain), a H3K4me0 (e.g., a 12-aa or a 30-aa N-terminal fragment of SEQ ID NO:393, 394, 395 or 396, such as the sequence set forth in SEQ ID NO:81 or 87), and a KRAB domain (e.g., KOX1 or ZIM3 KRAB domain); or d) a DNMT3 methyltransferase-binding domain (e.g., a Dnmt3L C-terminal domain), a TALE, a H3K4me0 (e.g., a 12-aa or a 30-aa N-terminal fragment of SEQ ID NO:393, 394, 395 or 396, such as the sequence set forth in SEQ ID NO:81 or 87), and a KRAB domain (e.g., KOX1 or ZIM3 KRAB domain).

In some embodiments, a fusion protein comprises, from N-terminus to C-terminus:

a) a H3K4me0 (e.g., a 12-aa or a 30-aa N-terminal fragment of SEQ ID NO:393, 394, 395 or 396, such as the sequence set forth in SEQ ID NO:81 or 87), a Dnmt3L (e.g., *Mus musculus* or *Apodemus sylvaticus* DNMT3L) C-terminal domain, a TALE, and a KRAB domain (e.g., KOX1 or ZIM3 KRAB domain);

b) a H3K4me0 (e.g., a 12-aa or a 30-aa N-terminal fragment of SEQ ID NO:393, 394, 395 or 396, such as the sequence set forth in SEQ ID NO:81 or 87), a TALE, a Dnmt3L (e.g., *Mus musculus* or *Apodemus sylvaticus* DNMT3L) C-terminal domain, and a KRAB domain (e.g., KOX1 or ZIM3 KRAB domain);

c) a TALE, a Dnmt3L (e.g., *Mus musculus* or *Apodemus sylvaticus* DNMT3L) C-terminal domain, a H3K4me0 (e.g., a 12-aa or a 30-aa N-terminal fragment of SEQ ID NO:393, 394, 395 or 396, such as the sequence set forth in SEQ ID NO:81 or 87), and a KRAB domain (e.g., KOX1 or ZIM3 KRAB domain); or d) a Dnmt3L (e.g., *Mus musculus* or *Apodemus sylvaticus* DNMT3L) C-terminal domain, a TALE, a H3K4me0 (e.g., a 12-aa or a 30-aa N-terminal fragment of SEQ ID NO:393, 394, 395 or 396, such as the sequence set forth in SEQ ID NO:81 or 87), and a KRAB domain (e.g., KOX1 or ZIM3 KRAB domain).

In some embodiments, a fusion protein comprises, from N-terminus to C-terminus:

a) a H3K4me0 (e.g., a 12-aa or a 30-aa N-terminal fragment of SEQ ID NO:393, 394, 395 or 396, such as the sequence set forth in SEQ ID NO:81 or 87), a DNMT3 methyltransferase-binding domain (e.g., a Dnmt3L C-terminal domain), a DNA-binding domain (e.g., Cas (e.g., *Staphylococcus aureus* dCas9, *Streptococcus pyogenes* dCas9, *S. aureus* dCas9, dCas12a or dCas12f), ZFP or TALE), and a KRAB domain (e.g., KOX1 or ZIM3 KRAB domain); or b) a H3K4me0 (e.g., a 12-aa or a 30-aa N-terminal fragment of SEQ ID NO:393, 394, 395 or 396, such as the sequence set forth in SEQ ID NO:81 or 87), a DNA-binding domain (e.g., Cas (e.g., *Staphylococcus aureus* dCas9, *Streptococcus pyogenes* dCas9, *S. aureus* dCas9, dCas12a or dCas12f), ZFP or TALE), a DNMT3 methyltransferase-binding domain (e.g., a Dnmt3L C-terminal domain), and a KRAB domain (e.g., KOX1 or ZIM3 KRAB domain).

In some embodiments, a fusion protein comprises, from N-terminus to C-terminus:

a) a H3K4me0 (e.g., a 12-aa or a 30-aa N-terminal fragment of SEQ ID NO:393, 394, 395 or 396, such as the sequence set forth in SEQ ID NO:81 or 87), a Dnmt3L (e.g., *Mus musculus* or *Apodemus sylvaticus* DNMT3L) C-terminal domain, a DNA-binding domain (e.g., Cas (e.g., *Staphylococcus aureus* dCas9, *Streptococcus pyogenes* dCas9, *S. aureus* dCas9, dCas12a or dCas12f), ZFP or TALE), and a KRAB domain (e.g., KOX1 or ZIM3 KRAB domain); or b) a H3K4me0 (e.g., a 12-aa or a 30-aa N-terminal fragment of SEQ ID NO:393, 394, 395 or 396, such as the sequence set forth in SEQ ID NO:81 or 87), a DNA-binding domain (e.g., Cas (e.g., *Staphylococcus aureus* dCas9, *Streptococcus pyogenes* dCas9, *S. aureus* dCas9, dCas12a or dCas12f), ZFP or TALE), a Dnmt3L (e.g., *Mus musculus* or *Apodemus sylvaticus* DNMT3L) C-terminal domain, and a KRAB domain (e.g., KOX1 or ZIM3 KRAB domain).

In some embodiments, a fusion protein comprises, from N-terminus to C-terminus:

a) a H3K4me0 (e.g., a 12-aa or a 30-aa N-terminal fragment of SEQ ID NO:393, 394, 395 or 396, such as the sequence set forth in SEQ ID NO:81 or 87), a DNMT3 methyltransferase-binding domain (e.g., a Dnmt3L C-terminal domain), a Cas (e.g., *Staphylococcus aureus* dCas9, *Streptococcus pyogenes* dCas9, *S. aureus* dCas9, dCas12a or dCas12f), and a KRAB domain (e.g., KOX1 or ZIM3 KRAB domain); or b) a H3K4me0 (e.g., a 12-aa or a 30-aa N-terminal fragment of SEQ ID NO:393, 394, 395 or 396, such as the sequence set forth in SEQ ID NO:81 or 87), a Cas (e.g., *Staphylococcus aureus* dCas9, *Streptococcus pyogenes* dCas9, *S. aureus* dCas9, dCas12a or dCas12f), a DNMT3 methyltransferase-binding domain (e.g., a Dnmt3L C-terminal domain), and a KRAB domain (e.g., KOX1 or ZIM3 KRAB domain).

In some embodiments, a fusion protein comprises, from N-terminus to C-terminus:

a) a H3K4me0 (e.g., a 12-aa or a 30-aa N-terminal fragment of SEQ ID NO:393, 394, 395 or 396, such as the sequence set forth in SEQ ID NO:81 or 87), a Dnmt3L (e.g., *Mus musculus* or *Apodemus sylvaticus* DNMT3L) C-terminal domain, a Cas (e.g., *Staphylococcus aureus* dCas9, *Streptococcus pyogenes* dCas9, *S. aureus* dCas9, dCas12a or dCas12f), and a KRAB domain (e.g., KOX1 or ZIM3 KRAB domain); or b) a H3K4me0 (e.g., a 12-aa or a 30-aa N-terminal fragment of SEQ ID NO:393, 394, 395 or 396, such as the sequence set forth in SEQ ID NO:81 or 87), a Cas (e.g., *Staphylococcus aureus* dCas9, *Streptococcus pyogenes* dCas9, *S. aureus* dCas9, dCas12a or dCas12f), a Dnmt3L (e.g., *Mus musculus* or *Apodemus sylvaticus* DNMT3L) C-terminal domain, and a KRAB domain (e.g., KOX1 or ZIM3 KRAB domain).

In some embodiments, a fusion protein comprises, from N-terminus to C-terminus:

a) a H3K4me0 (e.g., a 12-aa or a 30-aa N-terminal fragment of SEQ ID NO:393, 394, 395 or 396, such as the sequence set forth in SEQ ID NO:81 or 87), a DNMT3 methyltransferase-binding domain (e.g., a Dnmt3L C-terminal domain), a ZFP, and a KRAB domain (e.g., KOX1 or ZIM3 KRAB domain); or b) a H3K4me0 (e.g., a 12-aa or a 30-aa N-terminal fragment of SEQ ID NO:393, 394, 395 or 396, such as the sequence set forth in SEQ ID NO:81 or 87), a ZFP, a DNMT3 methyltransferase-binding domain (e.g., a Dnmt3L C-terminal domain), and a KRAB domain (e.g., KOX1 or ZIM3 KRAB domain).

In some embodiments, a fusion protein comprises, from N-terminus to C-terminus:

a) a H3K4me0 (e.g., a 12-aa or a 30-aa N-terminal fragment of SEQ ID NO:393, 394, 395 or 396, such as the sequence set forth in SEQ ID NO:81 or 87), a Dnmt3L (e.g., *Mus musculus* or *Apodemus sylvaticus* DNMT3L) C-terminal domain, a ZFP, and a KRAB domain (e.g., KOX1 or ZIM3 KRAB domain); or b) a H3K4me0 (e.g., a 12-aa or a 30-aa N-terminal fragment of SEQ ID NO:393, 394, 395 or 396, such as the sequence set forth in SEQ ID NO:81 or 87), a ZFP, a Dnmt3L (e.g., *Mus musculus* or *Apodemus sylvaticus* DNMT3L) C-terminal domain, and a KRAB domain (e.g., KOX1 or ZIM3 KRAB domain).

In some embodiments, a fusion protein comprises, from N-terminus to C-terminus:

a) a H3K4me0 (e.g., a 12-aa or a 30-aa N-terminal fragment of SEQ ID NO:393, 394, 395 or 396, such as the sequence set forth in SEQ ID NO:81 or 87), a DNMT3 methyltransferase-binding domain (e.g., a Dnmt3L C-terminal domain), a TALE, and a KRAB domain (e.g., KOX1 or ZIM3 KRAB domain); or b) a H3K4me0 (e.g., a 12-aa or a 30-aa N-terminal fragment of SEQ ID NO:393, 394, 395 or 396, such as the sequence set forth in SEQ ID NO:81 or 87), a TALE, a DNMT3 methyltransferase-binding domain (e.g., a Dnmt3L C-terminal domain), and a KRAB domain (e.g., KOX1 or ZIM3 KRAB domain).

In some embodiments, a fusion protein comprises, from N-terminus to C-terminus:
  a) a H3K4me0 (e.g., a 12-aa or a 30-aa N-terminal fragment of SEQ ID NO:393, 394, 395 or 396, such as the sequence set forth in SEQ ID NO:81 or 87), a Dnmt3L (e.g., *Mus musculus* or *Apodemus sylvaticus* DNMT3L) C-terminal domain, a TALE, and a KRAB domain (e.g., KOX1 or ZIM3 KRAB domain); or
  b) a H3K4me0 (e.g., a 12-aa or a 30-aa N-terminal fragment of SEQ ID NO:393, 394, 395 or 396, such as the sequence set forth in SEQ ID NO:81 or 87), a TALE, a Dnmt3L (e.g., *Mus musculus* or *Apodemus sylvaticus* DNMT3L) C-terminal domain, and a KRAB domain (e.g., KOX1 or ZIM3 KRAB domain).

In some embodiments, a fusion protein comprises, from N-terminus to C-terminus, a H3K4me0 (e.g., a 12-aa or a 30-aa N-terminal fragment of SEQ ID NO:393, 394, 395 or 396, such as the sequence set forth in SEQ ID NO:81 or 87), a DNMT3 methyltransferase-binding domain (e.g., a Dnmt3L C-terminal domain), a DNA-binding domain (e.g., Cas (e.g., *Staphylococcus aureus* dCas9, *Streptococcus pyogenes* dCas9, *S. aureus* dCas9, dCas12a or dCas12f), ZFP or TALE), and a KRAB domain (e.g., KOX1 or ZIM3 KRAB domain).

In some embodiments, a fusion protein comprises, from N-terminus to C-terminus, a H3K4me0 (e.g., a 12-aa or a 30-aa N-terminal fragment of SEQ ID NO:393, 394, 395 or 396, such as the sequence set forth in SEQ ID NO:81 or 87), a Dnmt3L (e.g., *Mus musculus* or *Apodemus sylvaticus* DNMT3L) C-terminal domain, a DNA-binding domain (e.g., Cas (e.g., *Staphylococcus aureus* dCas9, *Streptococcus pyogenes* dCas9, *S. aureus* dCas9, dCas12a or dCas12f), ZFP or TALE), and a KRAB domain (e.g., KOX1 or ZIM3 KRAB domain).

In some embodiments, a fusion protein comprises, from N-terminus to C-terminus, a H3K4me0 (e.g., a 12-aa or a 30-aa N-terminal fragment of SEQ ID NO:393, 394, 395 or 396, such as the sequence set forth in SEQ ID NO:81 or 87), a DNMT3 methyltransferase-binding domain (e.g., a Dnmt3L C-terminal domain), a Cas (e.g., *Staphylococcus aureus* dCas9, *Streptococcus pyogenes* dCas9, *S. aureus* dCas9, dCas12a or dCas12f), and a KRAB domain (e.g., KOX1 or ZIM3 KRAB domain).

In some embodiments, a fusion protein comprises, from N-terminus to C-terminus, a H3K4me0 (e.g., a 12-aa or a 30-aa N-terminal fragment of SEQ ID NO:393, 394, 395 or 396, such as the sequence set forth in SEQ ID NO:81 or 87), a Dnmt3L (e.g., *Mus musculus* or *Apodemus sylvaticus* DNMT3L) C-terminal domain, a Cas (e.g., *Staphylococcus aureus* dCas9, *Streptococcus pyogenes* dCas9, *S. aureus* dCas9, dCas12a or dCas12f), and a KRAB domain (e.g., KOX1 or ZIM3 KRAB domain).

In some embodiments, a fusion protein comprises, from N-terminus to C-terminus, a H3K4me0 (e.g., a 12-aa or a 30-aa N-terminal fragment of SEQ ID NO:393, 394, 395 or 396, such as the sequence set forth in SEQ ID NO:81 or 87), a DNMT3 methyltransferase-binding domain (e.g., a Dnmt3L C-terminal domain), a ZFP, and a KRAB domain (e.g., KOX1 or ZIM3 KRAB domain).

In some embodiments, a fusion protein comprises, from N-terminus to C-terminus, a H3K4me0 (e.g., a 12-aa or a 30-aa N-terminal fragment of SEQ ID NO:393, 394, 395 or 396, such as the sequence set forth in SEQ ID NO:81 or 87), a Dnmt3L (e.g., *Mus musculus* or *Apodemus sylvaticus* DNMT3L) C-terminal domain, a ZFP, and a KRAB domain (e.g., KOX1 or ZIM3 KRAB domain).

In some embodiments, a fusion protein comprises, from N-terminus to C-terminus, a H3K4me0 (e.g., a 12-aa or a 30-aa N-terminal fragment of SEQ ID NO:393, 394, 395 or 396, such as the sequence set forth in SEQ ID NO:81 or 87), a DNMT3 methyltransferase-binding domain (e.g., a Dnmt3L C-terminal domain), a TALE, and a KRAB domain (e.g., KOX1 or ZIM3 KRAB domain).

In some embodiments, a fusion protein comprises, from N-terminus to C-terminus, a H3K4me0 (e.g., a 12-aa or a 30-aa N-terminal fragment of SEQ ID NO:393, 394, 395 or 396, such as the sequence set forth in SEQ ID NO:81 or 87), a Dnmt3L (e.g., *Mus musculus* or *Apodemus sylvaticus* DNMT3L) C-terminal domain, a TALE, and a KRAB domain (e.g., KOX1 or ZIM3 KRAB domain).

In some embodiments, a fusion protein comprises, from N-terminus to C-terminus, a H3K4me0 (e.g., a 12-aa or a 30-aa N-terminal fragment of SEQ ID NO:393, 394, 395 or 396, such as the sequence set forth in SEQ ID NO:81 or 87), a DNA-binding domain (e.g., Cas (e.g., *Staphylococcus aureus* dCas9, *Streptococcus pyogenes* dCas9, *S. aureus* dCas9, dCas12a or dCas12f), ZFP or TALE), a DNMT3 methyltransferase-binding domain (e.g., a Dnmt3L C-terminal domain), and a KRAB domain (e.g., KOX1 or ZIM3 KRAB domain).

In some embodiments, a fusion protein comprises, from N-terminus to C-terminus, a H3K4me0 (e.g., a 12-aa or a 30-aa N-terminal fragment of SEQ ID NO:393, 394, 395 or 396, such as the sequence set forth in SEQ ID NO:81 or 87), a DNA-binding domain (e.g., Cas (e.g., *Staphylococcus aureus* dCas9, *Streptococcus pyogenes* dCas9, *S. aureus* dCas9, dCas12a or dCas12f), ZFP or TALE), a Dnmt3L (e.g., *Mus musculus* or *Apodemus sylvaticus* DNMT3L) C-terminal domain, and a KRAB domain (e.g., KOX1 or ZIM3 KRAB domain).

In some embodiments, a fusion protein comprises, from N-terminus to C-terminus, a H3K4me0 (e.g., a 12-aa or a 30-aa N-terminal fragment of SEQ ID NO:393, 394, 395 or 396, such as the sequence set forth in SEQ ID NO:81 or 87), a Cas (e.g., *Staphylococcus aureus* dCas9, *Streptococcus pyogenes* dCas9, *S. aureus* dCas9, dCas12a or dCas12f), a DNMT3 methyltransferase-binding domain (e.g., a Dnmt3L C-terminal domain), and a KRAB domain (e.g., KOX1 or ZIM3 KRAB domain).

In some embodiments, a fusion protein comprises, from N-terminus to C-terminus, a H3K4me0 (e.g., a 12-aa or a 30-aa N-terminal fragment of SEQ ID NO:393, 394, 395 or 396, such as the sequence set forth in SEQ ID NO:81 or 87), a Cas (e.g., *Staphylococcus aureus* dCas9, *Streptococcus pyogenes* dCas9, *S. aureus* dCas9, dCas12a or dCas12f), a Dnmt3L (e.g., *Mus musculus* or *Apodemus sylvaticus* DNMT3L) C-terminal domain, and a KRAB domain (e.g., KOX1 or ZIM3 KRAB domain).

In some embodiments, a fusion protein comprises, from N-terminus to C-terminus, a H3K4me0 (e.g., a 12-aa or a 30-aa N-terminal fragment of SEQ ID NO:393, 394, 395 or 396, such as the sequence set forth in SEQ ID NO:81 or 87), a ZFP, a DNMT3 methyltransferase-binding domain (e.g., a Dnmt3L C-terminal domain), and a KRAB domain (e.g., KOX1 or ZIM3 KRAB domain).

In some embodiments, a fusion protein comprises, from N-terminus to C-terminus, a H3K4me0 (e.g., a 12-aa or a 30-aa N-terminal fragment of SEQ ID NO:393, 394, 395 or 396, such as the sequence set forth in SEQ ID NO:81 or 87), a ZFP, a Dnmt3L (e.g., *Mus musculus* or *Apodemus sylvaticus* DNMT3L) C-terminal domain, and a KRAB domain (e.g., KOX1 or ZIM3 KRAB domain).

In some embodiments, a fusion protein comprises, from N-terminus to C-terminus, a H3K4me0 (e.g., a 12-aa or a 30-aa N-terminal fragment of SEQ ID NO:393, 394, 395 or 396, such as the sequence set forth in SEQ ID NO:81 or 87), a TALE, a DNMT3 methyltransferase-binding domain (e.g., a Dnmt3L C-terminal domain), and a KRAB domain (e.g., KOX1 or ZIM3 KRAB domain).

In some embodiments, a fusion protein comprises, from N-terminus to C-terminus, a H3K4me0 (e.g., a 12-aa or a 30-aa N-terminal fragment of SEQ ID NO:393, 394, 395 or 396, such as the sequence set forth in SEQ ID NO:81 or 87), a TALE, a Dnmt3L (e.g., *Mus musculus* or *Apodemus sylvaticus* DNMT3L) C-terminal domain, and a KRAB domain (e.g., KOX1 or ZIM3 KRAB domain).

In some embodiments, a fusion protein comprises, from N-terminus to C-terminus, a DNA-binding domain (e.g., Cas (e.g., *Staphylococcus aureus* dCas9, *Streptococcus pyogenes* dCas9, *S. aureus* dCas9, dCas12a or dCas12f), ZFP or TALE), a DNMT3 methyltransferase-binding domain (e.g., a Dnmt3L C-terminal domain), a H3K4me0 (e.g., a 12-aa or a 30-aa N-terminal fragment of SEQ ID NO:393, 394, 395 or 396, such as the sequence set forth in SEQ ID NO:81 or 87), and a KRAB domain (e.g., KOX1 or ZIM3 KRAB domain).

In some embodiments, a fusion protein comprises, from N-terminus to C-terminus, a DNA-binding domain (e.g., Cas (e.g., *Staphylococcus aureus* dCas9, *Streptococcus pyogenes* dCas9, *S. aureus* dCas9, dCas12a or dCas12f), ZFP or TALE), a Dnmt3L (e.g., *Mus musculus* or *Apodemus sylvaticus* DNMT3L) C-terminal domain, a H3K4me0 (e.g., a 12-aa or a 30-aa N-terminal fragment of SEQ ID NO:393, 394, 395 or 396, such as the sequence set forth in SEQ ID NO:81 or 87), and a KRAB domain (e.g., KOX1 or ZIM3 KRAB domain).

In some embodiments, a fusion protein comprises, from N-terminus to C-terminus, a Cas (e.g., *Staphylococcus aureus* dCas9, *Streptococcus pyogenes* dCas9, *S. aureus* dCas9, dCas12a or dCas12f), a DNMT3 methyltransferase-binding domain (e.g., a Dnmt3L C-terminal domain), a H3K4me0 (e.g., a 12-aa or a 30-aa N-terminal fragment of SEQ ID NO:393, 394, 395 or 396, such as the sequence set forth in SEQ ID NO:81 or 87), and a KRAB domain (e.g., KOX1 or ZIM3 KRAB domain).

In some embodiments, a fusion protein comprises, from N-terminus to C-terminus, a Cas (e.g., *Staphylococcus aureus* dCas9, *Streptococcus pyogenes* dCas9, *S. aureus* dCas9, dCas12a or dCas12f), a Dnmt3L (e.g., *Mus musculus* or *Apodemus sylvaticus* DNMT3L) C-terminal domain, a H3K4me0 (e.g., a 12-aa or a 30-aa N-terminal fragment of SEQ ID NO:393, 394, 395 or 396, such as the sequence set forth in SEQ ID NO:81 or 87), and a KRAB domain (e.g., KOX1 or ZIM3 KRAB domain).

In some embodiments, a fusion protein comprises, from N-terminus to C-terminus, a ZFP, a DNMT3 methyltransferase-binding domain (e.g., a Dnmt3L C-terminal domain), a H3K4me0 (e.g., a 12-aa or a 30-aa N-terminal fragment of SEQ ID NO:393, 394, 395 or 396, such as the sequence set forth in SEQ ID NO:81 or 87), and a KRAB domain (e.g., KOX1 or ZIM3 KRAB domain).

In some embodiments, a fusion protein comprises, from N-terminus to C-terminus, a ZFP, a Dnmt3L (e.g., *Mus musculus* or *Apodemus sylvaticus* DNMT3L) C-terminal domain, a H3K4me0 (e.g., a 12-aa or a 30-aa N-terminal fragment of SEQ ID NO:393, 394, 395 or 396, such as the sequence set forth in SEQ ID NO:81 or 87), and a KRAB domain (e.g., KOX1 or ZIM3 KRAB domain).

In some embodiments, a fusion protein comprises, from N-terminus to C-terminus, a TALE, a DNMT3 methyltransferase-binding domain (e.g., a Dnmt3L C-terminal domain), a H3K4me0 (e.g., a 12-aa or a 30-aa N-terminal fragment of SEQ ID NO:393, 394, 395 or 396, such as the sequence set forth in SEQ ID NO:81 or 87), and a KRAB domain (e.g., KOX1 or ZIM3 KRAB domain).

In some embodiments, a fusion protein comprises, from N-terminus to C-terminus, a TALE, a Dnmt3L (e.g., *Mus musculus* or *Apodemus sylvaticus* DNMT3L) C-terminal domain, a H3K4me0 (e.g., a 12-aa or a 30-aa N-terminal fragment of SEQ ID NO:393, 394, 395 or 396, such as the sequence set forth in SEQ ID NO:81 or 87), and a KRAB domain (e.g., KOX1 or ZIM3 KRAB domain).

In some embodiments, a fusion protein comprises, from N-terminus to C-terminus, a DNMT3 methyltransferase-binding domain (e.g., a Dnmt3L C-terminal domain), a DNA-binding domain (e.g., Cas (e.g., *Staphylococcus aureus* dCas9, *Streptococcus pyogenes* dCas9, *S. aureus* dCas9, dCas12a or dCas12f), ZFP or TALE), a H3K4me0 (e.g., a 12-aa or a 30-aa N-terminal fragment of SEQ ID NO:393, 394, 395 or 396, such as the sequence set forth in SEQ ID NO:81 or 87), and a KRAB domain (e.g., KOX1 or ZIM3 KRAB domain).

In some embodiments, a fusion protein comprises, from N-terminus to C-terminus, a Dnmt3L (e.g., *Mus musculus* or *Apodemus sylvaticus* DNMT3L) C-terminal domain, a DNA-binding domain (e.g., Cas (e.g., *Staphylococcus aureus* dCas9, *Streptococcus pyogenes* dCas9, *S. aureus* dCas9, dCas12a or dCas12f), ZFP or TALE), a H3K4me0 (e.g., a 12-aa or a 30-aa N-terminal fragment of SEQ ID NO:393, 394, 395 or 396, such as the sequence set forth in SEQ ID NO:81 or 87), and a KRAB domain (e.g., KOX1 or ZIM3 KRAB domain).

In some embodiments, a fusion protein comprises, from N-terminus to C-terminus, a DNMT3 methyltransferase-binding domain (e.g., a Dnmt3L C-terminal domain), a Cas (e.g., *Staphylococcus aureus* dCas9, *Streptococcus pyogenes* dCas9, *S. aureus* dCas9, dCas12a or dCas12f), a H3K4me0 (e.g., a 12-aa or a 30-aa N-terminal fragment of SEQ ID NO:393, 394, 395 or 396, such as the sequence set forth in SEQ ID NO:81 or 87), and a KRAB domain (e.g., KOX1 or ZIM3 KRAB domain).

In some embodiments, a fusion protein comprises, from N-terminus to C-terminus, a Dnmt3L (e.g., *Mus musculus* or *Apodemus sylvaticus* DNMT3L) C-terminal domain, a Cas (e.g., *Staphylococcus aureus* dCas9, *Streptococcus pyogenes* dCas9, *S. aureus* dCas9, dCas12a or dCas12f), a H3K4me0 (e.g., a 12-aa or a 30-aa N-terminal fragment of SEQ ID NO:393, 394, 395 or 396, such as the sequence set forth in SEQ ID NO:81 or 87), and a KRAB domain (e.g., KOX1 or ZIM3 KRAB domain).

In some embodiments, a fusion protein comprises, from N-terminus to C-terminus, a DNMT3 methyltransferase-binding domain (e.g., a Dnmt3L C-terminal domain), a ZFP, a H3K4me0 (e.g., a 12-aa or a 30-aa N-terminal fragment of SEQ ID NO:393, 394, 395 or 396, such as the sequence set forth in SEQ ID NO:81 or 87), and a KRAB domain (e.g., KOX1 or ZIM3 KRAB domain).

In some embodiments, a fusion protein comprises, from N-terminus to C-terminus, a Dnmt3L (e.g., *Mus musculus* or *Apodemus sylvaticus* DNMT3L) C-terminal domain, a ZFP, a H3K4me0 (e.g., a 12-aa or a 30-aa N-terminal fragment of SEQ ID NO:393, 394, 395 or 396, such as the sequence set forth in SEQ ID NO:81 or 87), and a KRAB domain (e.g., KOX1 or ZIM3 KRAB domain).

In some embodiments, a fusion protein comprises, from N-terminus to C-terminus, a DNMT3 methyltransferase-binding domain (e.g., a Dnmt3L C-terminal domain), a TALE, a H3K4me0 (e.g., a 12-aa or a 30-aa N-terminal fragment of SEQ ID NO:393, 394, 395 or 396, such as the sequence set forth in SEQ ID NO:81 or 87), and a KRAB domain (e.g., KOX1 or ZIM3 KRAB domain).

In some embodiments, a fusion protein comprises, from N-terminus to C-terminus, a Dnmt3L (e.g., *Mus musculus* or *Apodemus sylvaticus* DNMT3L) C-terminal domain, a H3K4me0 (e.g., a 12-aa or a 30-aa N-terminal fragment of SEQ ID NO:393, 394, 395 or 396, such as the sequence set forth in SEQ ID NO:81 or 87), and a KRAB domain (e.g., KOX1 or ZIM3 KRAB domain).

In some embodiments, a fusion protein comprises, from N-terminus to C-terminus, a DNMT3 methyltransferase-binding domain (e.g., a Dnmt3L C-terminal domain), a H3K4me0 (e.g., a 12-aa or a 30-aa N-terminal fragment of SEQ ID NO:393, 394, 395 or 396, such as the sequence set forth in SEQ ID NO:81 or 87), a DNA-binding domain (e.g., Cas (e.g., *Staphylococcus aureus* dCas9, *Streptococcus pyogenes* dCas9, *S. aureus* dCas9, dCas12a or dCas12f), ZFP or TALE), and a KRAB domain (e.g., KOX1 or ZIM3 KRAB domain).

In some embodiments, a fusion protein comprises, from N-terminus to C-terminus, a Dnmt3L (e.g., *Mus musculus* or *Apodemus sylvaticus* DNMT3L) C-terminal domain, a H3K4me0 (e.g., a 12-aa or a 30-aa N-terminal fragment of SEQ ID NO:393, 394, 395 or 396, such as the sequence set forth in SEQ ID NO:81 or 87), a DNA-binding domain (e.g., Cas (e.g., *Staphylococcus aureus* dCas9, *Streptococcus pyogenes* dCas9, *S. aureus* dCas9, dCas12a or dCas12f), ZFP or TALE), and a KRAB domain (e.g., KOX1 or ZIM3 KRAB domain).

In some embodiments, a fusion protein comprises, from N-terminus to C-terminus, a DNMT3 methyltransferase-binding domain (e.g., a Dnmt3L C-terminal domain), a H3K4me0 (e.g., a 12-aa or a 30-aa N-terminal fragment of SEQ ID NO:393, 394, 395 or 396, such as the sequence set forth in SEQ ID NO:81 or 87), a Cas (e.g., *Staphylococcus aureus* dCas9, *Streptococcus pyogenes* dCas9, *S. aureus* dCas9, dCas12a or dCas12f), and a KRAB domain (e.g., KOX1 or ZIM3 KRAB domain).

In some embodiments, a fusion protein comprises, from N-terminus to C-terminus, a Dnmt3L (e.g., *Mus musculus* or *Apodemus sylvaticus* DNMT3L) C-terminal domain, a H3K4me0 (e.g., a 12-aa or a 30-aa N-terminal fragment of SEQ ID NO:393, 394, 395 or 396, such as the sequence set forth in SEQ ID NO:81 or 87), a Cas (e.g., *Staphylococcus aureus* dCas9, *Streptococcus pyogenes* dCas9, *S. aureus* dCas9, dCas12a or dCas12f), and a KRAB domain (e.g., KOX1 or ZIM3 KRAB domain).

In some embodiments, a fusion protein comprises, from N-terminus to C-terminus, a DNMT3 methyltransferase-binding domain (e.g., a Dnmt3L C-terminal domain), a H3K4me0 (e.g., a 12-aa or a 30-aa N-terminal fragment of SEQ ID NO:393, 394, 395 or 396, such as the sequence set forth in SEQ ID NO:81 or 87), a ZFP, and a KRAB domain (e.g., KOX1 or ZIM3 KRAB domain).

In some embodiments, a fusion protein comprises, from N-terminus to C-terminus, a Dnmt3L (e.g., *Mus musculus* or *Apodemus sylvaticus* DNMT3L) C-terminal domain, a H3K4me0 (e.g., a 12-aa or a 30-aa N-terminal fragment of SEQ ID NO:393, 394, 395 or 396, such as the sequence set forth in SEQ ID NO:81 or 87), a ZFP, and a KRAB domain (e.g., KOX1 or ZIM3 KRAB domain).

In some embodiments, a fusion protein comprises, from N-terminus to C-terminus, a DNMT3 methyltransferase-binding domain (e.g., a Dnmt3L C-terminal domain), a H3K4me0 (e.g., a 12-aa or a 30-aa N-terminal fragment of SEQ ID NO:393, 394, 395 or 396, such as the sequence set forth in SEQ ID NO:81 or 87), a TALE, and a KRAB domain (e.g., KOX1 or ZIM3 KRAB domain).

In some embodiments, a fusion protein comprises, from N-terminus to C-terminus, a Dnmt3L (e.g., *Mus musculus* or *Apodemus sylvaticus* DNMT3L) C-terminal domain, a H3K4me0 (e.g., a 12-aa or a 30-aa N-terminal fragment of SEQ ID NO:393, 394, 395 or 396, such as the sequence set forth in SEQ ID NO:81 or 87), a TALE, and a KRAB domain (e.g., KOX1 or ZIM3 KRAB domain).

In some embodiments, a fusion protein comprises, from N-terminus to C-terminus, a DNA-binding domain (e.g., Cas (e.g., *Staphylococcus aureus* dCas9, *Streptococcus pyogenes* dCas9, *S. aureus* dCas9, dCas12a or dCas12f), ZFP or TALE), a H3K4me0 (e.g., a 12-aa or a 30-aa N-terminal fragment of SEQ ID NO:393, 394, 395 or 396, such as the sequence set forth in SEQ ID NO:81 or 87), a DNMT3 methyltransferase-binding domain (e.g., a Dnmt3L C-terminal domain), and a KRAB domain (e.g., KOX1 or ZIM3 KRAB domain).

In some embodiments, a fusion protein comprises, from N-terminus to C-terminus, a DNA-binding domain (e.g., Cas (e.g., *Staphylococcus aureus* dCas9, *Streptococcus pyogenes* dCas9, *S. aureus* dCas9, dCas12a or dCas12f), ZFP or TALE), a H3K4me0 (e.g., a 12-aa or a 30-aa N-terminal fragment of SEQ ID NO:393, 394, 395 or 396, such as the sequence set forth in SEQ ID NO:81 or 87), a Dnmt3L (e.g., *Mus musculus* or *Apodemus sylvaticus* DNMT3L) C-terminal domain, and a KRAB domain (e.g., KOX1 or ZIM3 KRAB domain).

In some embodiments, a fusion protein comprises, from N-terminus to C-terminus, a Cas (e.g., *Staphylococcus aureus* dCas9, *Streptococcus pyogenes* dCas9, *S. aureus* dCas9, dCas12a or dCas12f), a H3K4me0 (e.g., a 12-aa or a 30-aa N-terminal fragment of SEQ ID NO:393, 394, 395 or 396, such as the sequence set forth in SEQ ID NO:81 or 87), a DNMT3 methyltransferase-binding domain (e.g., a Dnmt3L C-terminal domain), and a KRAB domain (e.g., KOX1 or ZIM3 KRAB domain).

In some embodiments, a fusion protein comprises, from N-terminus to C-terminus, a Cas (e.g., *Staphylococcus aureus* dCas9, *Streptococcus pyogenes* dCas9, *S. aureus* dCas9, dCas12a or dCas12f), a H3K4me0 (e.g., a 12-aa or a 30-aa N-terminal fragment of SEQ ID NO:393, 394, 395 or 396, such as the sequence set forth in SEQ ID NO:81 or 87), a Dnmt3L (e.g., *Mus musculus* or *Apodemus sylvaticus* DNMT3L) C-terminal domain, and a KRAB domain (e.g., KOX1 or ZIM3 KRAB domain).

In some embodiments, a fusion protein comprises, from N-terminus to C-terminus, a ZFP, a H3K4me0 (e.g., a 12-aa or a 30-aa N-terminal fragment of SEQ ID NO:393, 394, 395 or 396, such as the sequence set forth in SEQ ID NO:81 or 87), a DNMT3 methyltransferase-binding domain (e.g., a Dnmt3L C-terminal domain), and a KRAB domain (e.g., KOX1 or ZIM3 KRAB domain).

In some embodiments, a fusion protein comprises, from N-terminus to C-terminus, a ZFP, a H3K4me0 (e.g., a 12-aa or a 30-aa N-terminal fragment of SEQ ID NO:393, 394, 395 or 396, such as the sequence set forth in SEQ ID NO:81 or 87), a Dnmt3L (e.g., *Mus musculus* or *Apodemus sylvaticus* DNMT3L) C-terminal domain, and a KRAB domain (e.g., KOX1 or ZIM3 KRAB domain).

In some embodiments, a fusion protein comprises, from N-terminus to C-terminus, a TALE, a H3K4me0 (e.g., a 12-aa or a 30-aa N-terminal fragment of SEQ ID NO:393, 394, 395 or 396, such as the sequence set forth in SEQ ID NO:81 or 87), a DNMT3 methyltransferase-binding domain (e.g., a Dnmt3L C-terminal domain), and a KRAB domain (e.g., KOX1 or ZIM3 KRAB domain).

In some embodiments, a fusion protein comprises, from N-terminus to C-terminus, a TALE, a H3K4me0 (e.g., a 12-aa or a 30-aa N-terminal fragment of SEQ ID NO:393, 394, 395 or 396, such as the sequence set forth in SEQ ID NO:81 or 87), a Dnmt3L (e.g., *Mus musculus* or *Apodemus sylvaticus* DNMT3L) C-terminal domain, and a KRAB domain (e.g., KOX1 or ZIM3 KRAB domain).

In some embodiments, a fusion protein comprises, from N-terminus to C-terminus:
  a) a H3K4me0 (e.g., a 12-aa or a 30-aa N-terminal fragment of SEQ ID NO:393, 394, 395 or 396, such as the sequence set forth in SEQ ID NO:81 or 87), a KRAB domain (e.g., KOX1 or ZIM3 KRAB domain), a DNMT3 methyltransferase-binding domain (e.g., a Dnmt3L C-terminal domain), and a DNA-binding domain (e.g., Cas (e.g., a *Staphylococcus aureus* dCas9, a *Streptococcus pyogenes* dCas9, a *S. aureus* dCas9 or a Cas12a), ZFP or TALE);
  b) a DNA-binding domain (e.g., Cas (e.g., *Staphylococcus aureus* dCas9, *Streptococcus pyogenes* dCas9, *S. aureus* dCas9, dCas12a or dCas12f), ZFP or TALE), a DNMT3 methyltransferase-binding domain (e.g., a Dnmt3L C-terminal domain), a KRAB domain (e.g., KOX1 or ZIM3 KRAB domain), and a H3K4me0 (e.g., a 12-aa or a 30-aa N-terminal fragment of SEQ ID NO:393, 394, 395 or 396, such as the sequence set forth in SEQ ID NO:81 or 87);
  c) a DNMT3 methyltransferase-binding domain (e.g., a Dnmt3L C-terminal domain), a KRAB domain (e.g., KOX1 or ZIM3 KRAB domain), a H3K4me0 (e.g., a 12-aa or a 30-aa N-terminal fragment of SEQ ID NO:393, 394, 395 or 396, such as the sequence set forth in SEQ ID NO:81 or 87), and a DNA-binding domain (e.g., Cas (e.g., *Staphylococcus aureus* dCas9, *Streptococcus pyogenes* dCas9, *S. aureus* dCas9, dCas12a or dCas12f), ZFP or TALE); or
  d) a DNA-binding domain (e.g., Cas (e.g., *Staphylococcus aureus* dCas9, *Streptococcus pyogenes* dCas9, *S. aureus* dCas9, dCas12a or dCas12f), ZFP or TALE), a H3K4me0 (e.g., a 12-aa or a 30-aa N-terminal fragment of SEQ ID NO:393, 394, 395 or 396, such as the sequence set forth in SEQ ID NO:81 or 87), a KRAB domain (e.g., KOX1 or ZIM3 KRAB domain), and a DNMT3 methyltransferase-binding domain (e.g., a Dnmt3L C-terminal domain).

In some embodiments, a fusion protein comprises, from N-terminus to C-terminus:
  a) a H3K4me0 (e.g., a 12-aa or a 30-aa N-terminal fragment of SEQ ID NO:393, 394, 395 or 396, such as the sequence set forth in SEQ ID NO:81 or 87), a KRAB domain (e.g., KOX1 or ZIM3 KRAB domain), a Dnmt3L (e.g., *Mus musculus* or *Apodemus sylvaticus* DNMT3L) C-terminal domain, and a DNA-binding domain (e.g., Cas (e.g., *Staphylococcus aureus* dCas9, *Streptococcus pyogenes* dCas9, *S. aureus* dCas9, dCas12a or dCas12f), ZFP or TALE);
  b) a DNA-binding domain (e.g., Cas (e.g., *Staphylococcus aureus* dCas9, *Streptococcus pyogenes* dCas9, *S. aureus* dCas9, dCas12a or dCas12f), ZFP or TALE), a Dnmt3L (e.g., *Mus musculus* or *Apodemus sylvaticus* DNMT3L) C-terminal domain, a KRAB domain (e.g., KOX1 or ZIM3 KRAB domain), and a H3K4me0 (e.g., a 12-aa or a 30-aa N-terminal fragment of SEQ ID NO:393, 394, 395 or 396, such as the sequence set forth in SEQ ID NO:81 or 87);
  c) a Dnmt3L (e.g., *Mus musculus* or *Apodemus sylvaticus* DNMT3L) C-terminal domain, a KRAB domain (e.g., KOX1 or ZIM3 KRAB domain), a H3K4me0 (e.g., a 12-aa or a 30-aa N-terminal fragment of SEQ ID NO:393, 394, 395 or 396, such as the sequence set forth in SEQ ID NO:81 or 87), and a DNA-binding domain (e.g., Cas (e.g., *Staphylococcus aureus* dCas9, *Streptococcus pyogenes* dCas9, *S. aureus* dCas9, dCas12a or dCas12f), ZFP or TALE); or
  d) a DNA-binding domain (e.g., Cas (e.g., *Staphylococcus aureus* dCas9, *Streptococcus pyogenes* dCas9, *S. aureus* dCas9, dCas12a or dCas12f), ZFP or TALE), a H3K4me0 (e.g., a 12-aa or a 30-aa N-terminal fragment of SEQ ID NO:393, 394, 395 or 396, such as the sequence set forth in SEQ ID NO:81 or 87), a KRAB domain (e.g., KOX1 or ZIM3 KRAB domain), and a Dnmt3L (e.g., *Mus musculus* or *Apodemus sylvaticus* DNMT3L) C-terminal domain.

In some embodiments, a fusion protein comprises, from N-terminus to C-terminus:
  a) a H3K4me0 (e.g., a 12-aa or a 30-aa N-terminal fragment of SEQ ID NO:393, 394, 395 or 396, such as the sequence set forth in SEQ ID NO:81 or 87), a KRAB domain (e.g., KOX1 or ZIM3 KRAB domain), a DNMT3 methyltransferase-binding domain (e.g., a Dnmt3L C-terminal domain), and a Cas (e.g., *Staphylococcus aureus* dCas9, *Streptococcus pyogenes* dCas9, *S. aureus* dCas9, dCas12a or dCas12f);
  b) a Cas (e.g., *Staphylococcus aureus* dCas9, *Streptococcus pyogenes* dCas9, *S. aureus* dCas9, dCas12a or dCas12f), a DNMT3 methyltransferase-binding domain (e.g., a Dnmt3L C-terminal domain), a KRAB domain (e.g., KOX1 or ZIM3 KRAB domain), and a H3K4me0 (e.g., a 12-aa or a 30-aa N-terminal fragment of SEQ ID NO:393, 394, 395 or 396, such as the sequence set forth in SEQ ID NO:81 or 87); c) a DNMT3 methyltransferase-binding domain (e.g., a Dnmt3L C-terminal domain), a H3K4me0 (e.g., a 12-aa or a 30-aa N-terminal fragment of SEQ ID NO:393, 394, 395 or 396, such as the sequence set forth in SEQ ID NO:81 or 87), a KRAB domain (e.g., KOX1 or ZIM3 KRAB domain), and a Cas (e.g., *Staphylococcus aureus* dCas9, *Streptococcus pyogenes* dCas9, *S. aureus* dCas9, dCas12a or dCas12f); or
  d) a Cas (e.g., *Staphylococcus aureus* dCas9, *Streptococcus pyogenes* dCas9, *S. aureus* dCas9, dCas12a or dCas12f), a H3K4me0 (e.g., a 12-aa or a 30-aa N-terminal fragment of SEQ ID NO:393, 394, 395 or 396, such as the sequence set forth in SEQ ID NO:81 or 87), a KRAB domain (e.g., KOX1 or ZIM3 KRAB domain), and a DNMT3 methyltransferase-binding domain (e.g., a Dnmt3L C-terminal domain).

In some embodiments, a fusion protein comprises, from N-terminus to C-terminus:
  a) a H3K4me0 (e.g., a 12-aa or a 30-aa N-terminal fragment of SEQ ID NO:393, 394, 395 or 396, such as the sequence set forth in SEQ ID NO:81 or 87), a KRAB domain (e.g., KOX1 or ZIM3 KRAB domain), a Dnmt3L (e.g., *Mus musculus* or *Apodemus* sylvaticus DNMT3L) C-terminal domain, and a Cas (e.g., *Staphylococcus aureus* dCas9, *Streptococcus pyogenes* dCas9, *S. aureus* dCas9, dCas12a or dCas12f);

b) a Cas (e.g., *Staphylococcus aureus* dCas9, *Streptococcus pyogenes* dCas9, *S. aureus* dCas9, dCas12a or dCas12f), a Dnmt3L (e.g., *Mus musculus* or *Apodemus sylvaticus* DNMT3L) C-terminal domain, a KRAB domain (e.g., KOX1 or ZIM3 KRAB domain), and a H3K4me0 (e.g., a 12-aa or a 30-aa N-terminal fragment of SEQ ID NO:393, 394, 395 or 396, such as the sequence set forth in SEQ ID NO:81 or 87); c) a Dnmt3L (e.g., *Mus musculus* or *Apodemus sylvaticus* DNMT3L) C-terminal domain, a KRAB domain (e.g., KOX1 or ZIM3 KRAB domain), a H3K4me0 (e.g., a 12-aa or a 30-aa N-terminal fragment of SEQ ID NO:393, 394, 395 or 396, such as the sequence set forth in SEQ ID NO:81 or 87), and a Cas (e.g., *Staphylococcus aureus* dCas9, *Streptococcus pyogenes* dCas9, *S. aureus* dCas9, dCas12a or dCas12f); or d) a Cas (e.g., *Staphylococcus aureus* dCas9, *Streptococcus pyogenes* dCas9, *S. aureus* dCas9, dCas12a or dCas12f), a H3K4me0 (e.g., a 12-aa or a 30-aa N-terminal fragment of SEQ ID NO:393, 394, 395 or 396, such as the sequence set forth in SEQ ID NO:81 or 87), a KRAB domain (e.g., KOX1 or ZIM3 KRAB domain), and a Dnmt3L (e.g., *Mus musculus* or *Apodemus sylvaticus* DNMT3L) C-terminal domain.

In some embodiments, a fusion protein comprises, from N-terminus to C-terminus:

a) a H3K4me0 (e.g., a 12-aa or a 30-aa N-terminal fragment of SEQ ID NO:393, 394, 395 or 396, such as the sequence set forth in SEQ ID NO:81 or 87), a KRAB domain (e.g., KOX1 or ZIM3 KRAB domain), a DNMT3 methyltransferase-binding domain (e.g., a Dnmt3L C-terminal domain), and a ZFP;

b) a ZFP, a DNMT3 methyltransferase-binding domain (e.g., a Dnmt3L C-terminal domain), a KRAB domain (e.g., KOX1 or ZIM3 KRAB domain), and a H3K4me0 (e.g., a 12-aa or a 30-aa N-terminal fragment of SEQ ID NO:393, 394, 395 or 396, such as the sequence set forth in SEQ ID NO:81 or 87);

c) a DNMT3 methyltransferase-binding domain (e.g., a Dnmt3L C-terminal domain), a KRAB domain (e.g., KOX1 or ZIM3 KRAB domain), a H3K4me0 (e.g., a 12-aa or a 30-aa N-terminal fragment of SEQ ID NO:393, 394, 395 or 396, such as the sequence set forth in SEQ ID NO:81 or 87), and a ZFP; or d) a ZFP, a H3K4me0 (e.g., a 12-aa or a 30-aa N-terminal fragment of SEQ ID NO:393, 394, 395 or 396, such as the sequence set forth in SEQ ID NO:81 or 87), a KRAB domain (e.g., KOX1 or ZIM3 KRAB domain), and a Dnmt3L (e.g., *Mus musculus* or *Apodemus sylvaticus* DNMT3L) C-terminal domain.

In some embodiments, a fusion protein comprises, from N-terminus to C-terminus:

a) a H3K4me0 (e.g., a 12-aa or a 30-aa N-terminal fragment of SEQ ID NO:393, 394, 395 or 396, such as the sequence set forth in SEQ ID NO:81 or 87), a KRAB domain (e.g., KOX1 or ZIM3 KRAB domain), a DNMT3 methyltransferase-binding domain (e.g., a Dnmt3L C-terminal domain), and a TALE;

b) a TALE, a DNMT3 methyltransferase-binding domain (e.g., a Dnmt3L C-terminal domain), and a H3K4me0 (e.g., a 12-aa or a 30-aa N-terminal fragment of SEQ ID NO:393, 394, 395 or 396, such as the sequence set forth in SEQ ID NO:81 or 87);

c) a DNMT3 methyltransferase-binding domain (e.g., a Dnmt3L C-terminal domain), a KRAB domain (e.g., KOX1 or ZIM3 KRAB domain), a H3K4me0 (e.g., a 12-aa or a 30-aa N-terminal fragment of SEQ ID NO:393, 394, 395 or 396, such as the sequence set forth in SEQ ID NO:81 or 87), and a TALE; or d) a TALE, a H3K4me0 (e.g., a 12-aa or a 30-aa N-terminal fragment of SEQ ID NO:393, 394, 395 or 396, such as the sequence set forth in SEQ ID NO:81 or 87), a KRAB domain (e.g., KOX1 or ZIM3 KRAB domain), and a DNMT3 methyltransferase-binding domain (e.g., a Dnmt3L C-terminal domain).

In some embodiments, a fusion protein comprises, from N-terminus to C-terminus:

a) a H3K4me0 (e.g., a 12-aa or a 30-aa N-terminal fragment of SEQ ID NO:393, 394, 395 or 396, such as the sequence set forth in SEQ ID NO:81 or 87), a KRAB domain (e.g., KOX1 or ZIM3 KRAB domain), a Dnmt3L (e.g., *Mus musculus* or *Apodemus sylvaticus* DNMT3L) C-terminal domain, and a TALE;

b) a TALE, a Dnmt3L (e.g., *Mus musculus* or *Apodemus sylvaticus* DNMT3L) C-terminal domain, a KRAB domain (e.g., KOX1 or ZIM3 KRAB domain), and a H3K4me0 (e.g., a 12-aa or a 30-aa N-terminal fragment of SEQ ID NO:393, 394, 395 or 396, such as the sequence set forth in SEQ ID NO:81 or 87);

c) a Dnmt3L (e.g., *Mus musculus* or *Apodemus sylvaticus* DNMT3L) C-terminal domain, a KRAB domain (e.g., KOX1 or ZIM3 KRAB domain), a H3K4me0 (e.g., a 12-aa or a 30-aa N-terminal fragment of SEQ ID NO:393, 394, 395 or 396, such as the sequence set forth in SEQ ID NO:81 or 87), and a TALE; or d) a TALE, a H3K4me0 (e.g., a 12-aa or a 30-aa N-terminal fragment of SEQ ID NO:393, 394, 395 or 396, such as the sequence set forth in SEQ ID NO:81 or 87), a KRAB domain (e.g., KOX1 or ZIM3 KRAB domain), and a Dnmt3L (e.g., *Mus musculus* or *Apodemus sylvaticus* DNMT3L) C-terminal domain.

In some embodiments, a fusion protein comprises, from N-terminus to C-terminus:

a) a H3K4me0 (e.g., a 12-aa or a 30-aa N-terminal fragment of SEQ ID NO:393, 394, 395 or 396, such as the sequence set forth in SEQ ID NO:81 or 87), a KRAB domain (e.g., KOX1 or ZIM3 KRAB domain), a DNMT3 methyltransferase-binding domain (e.g., a Dnmt3L C-terminal domain), and a DNA-binding domain (e.g., Cas (e.g., *Staphylococcus aureus* dCas9, *Streptococcus pyogenes* dCas9, *S. aureus* dCas9, dCas12a or dCas12f), ZFP or TALE); or
b) a DNA-binding domain (e.g., Cas (e.g., *Staphylococcus aureus* dCas9, *Streptococcus pyogenes* dCas9, *S. aureus* dCas9, dCas12a or dCas12f), ZFP or TALE), a DNMT3 methyltransferase-binding domain (e.g., a Dnmt3L C-terminal domain), a KRAB domain (e.g., KOX1 or ZIM3 KRAB domain), and a H3K4me0 (e.g., a 12-aa or a 30-aa N-terminal fragment of SEQ ID NO:393, 394, 395 or 396, such as the sequence set forth in SEQ ID NO:81 or 87).

In some embodiments, a fusion protein comprises, from N-terminus to C-terminus:
a) a H3K4me0 (e.g., a 12-aa or a 30-aa N-terminal fragment of SEQ ID NO:393, 394, 395 or 396, such as the sequence set forth in SEQ ID NO:81 or 87), a KRAB domain (e.g., KOX1 or ZIM3 KRAB domain), a Dnmt3L (e.g., *Mus musculus* or *Apodemus sylvaticus* DNMT3L) C-terminal domain, and a DNA-binding domain (e.g., Cas (e.g., *Staphylococcus aureus* dCas9, *Streptococcus pyogenes* dCas9, *S. aureus* dCas9, dCas12a or dCas12f), ZFP or TALE); or
b) a DNA-binding domain (e.g., Cas (e.g., *Staphylococcus aureus* dCas9, *Streptococcus pyogenes* dCas9, *S. aureus* dCas9, dCas12a or dCas12f), ZFP or TALE), a Dnmt3L (e.g., *Mus musculus* or *Apodemus sylvaticus* DNMT3L) C-terminal domain, a KRAB domain (e.g., KOX1 or ZIM3 KRAB domain), and a H3K4me0 (e.g., a 12-aa or a 30-aa N-terminal fragment of SEQ ID NO:393, 394, 395 or 396, such as the sequence set forth in SEQ ID NO:81 or 87).

In some embodiments, a fusion protein comprises, from N-terminus to C-terminus:
a) a H3K4me0 (e.g., a 12-aa or a 30-aa N-terminal fragment of SEQ ID NO:393, 394, 395 or 396, such as the sequence set forth in SEQ ID NO:81 or 87), a KRAB domain (e.g., KOX1 or ZIM3 KRAB domain), a DNMT3 methyltransferase-binding domain (e.g., a Dnmt3L C-terminal domain), and a Cas (e.g., *Staphylococcus aureus* dCas9, *Streptococcus pyogenes* dCas9, *S. aureus* dCas9, dCas12a or dCas12f); or
b) a Cas (e.g., *Staphylococcus aureus* dCas9, *Streptococcus pyogenes* dCas9, *S. aureus* dCas9, dCas12a or dCas12f), a DNMT3 methyltransferase-binding domain (e.g., a Dnmt3L C-terminal domain), a KRAB domain (e.g., KOX1 or ZIM3 KRAB domain), and a H3K4me0 (e.g., a 12-aa or a 30-aa N-terminal fragment of SEQ ID NO:393, 394, 395 or 396, such as the sequence set forth in SEQ ID NO:81 or 87).

In some embodiments, a fusion protein comprises, from N-terminus to C-terminus:
a) a H3K4me0 (e.g., a 12-aa or a 30-aa N-terminal fragment of SEQ ID NO:393, 394, 395 or 396, such as the sequence set forth in SEQ ID NO:81 or 87), a KRAB domain (e.g., KOX1 or ZIM3 KRAB domain), a Dnmt3L (e.g., *Mus musculus* or *Apodemus sylvaticus* DNMT3L) C-terminal domain, and a Cas (e.g., *Staphylococcus aureus* dCas9, *Streptococcus pyogenes* dCas9, *S. aureus* dCas9, dCas12a or dCas12f); or
b) a Cas (e.g., *Staphylococcus aureus* dCas9, *Streptococcus pyogenes* dCas9, *S. aureus* dCas9, dCas12a or dCas12f), a Dnmt3L (e.g., *Mus musculus* or *Apodemus sylvaticus* DNMT3L) C-terminal domain, a KRAB domain (e.g., KOX1 or ZIM3 KRAB domain), and a H3K4me0 (e.g., a 12-aa or a 30-aa N-terminal fragment of SEQ ID NO:393, 394, 395 or 396, such as the sequence set forth in SEQ ID NO:81 or 87).

In some embodiments, a fusion protein comprises, from N-terminus to C-terminus:
a) a H3K4me0 (e.g., a 12-aa or a 30-aa N-terminal fragment of SEQ ID NO:393, 394, 395 or 396, such as the sequence set forth in SEQ ID NO:81 or 87), a KRAB domain (e.g., KOX1 or ZIM3 KRAB domain), a DNMT3 methyltransferase-binding domain (e.g., a Dnmt3L C-terminal domain), and a ZFP; or
b) a ZFP, a DNMT3 methyltransferase-binding domain (e.g., a Dnmt3L C-terminal domain), a KRAB domain (e.g., KOX1 or ZIM3 KRAB domain), and a H3K4me0 (e.g., a 12-aa or a 30-aa N-terminal fragment of SEQ ID NO:393, 394, 395 or 396, such as the sequence set forth in SEQ ID NO:81 or 87).

In some embodiments, a fusion protein comprises, from N-terminus to C-terminus:
a) a H3K4me0 (e.g., a 12-aa or a 30-aa N-terminal fragment of SEQ ID NO:393, 394, 395 or 396, such as the sequence set forth in SEQ ID NO:81 or 87), a KRAB domain (e.g., KOX1 or ZIM3 KRAB domain), a Dnmt3L (e.g., *Mus musculus* or *Apodemus sylvaticus* DNMT3L) C-terminal domain, and a ZFP; or
b) a ZFP, a Dnmt3L (e.g., *Mus musculus* or *Apodemus sylvaticus* DNMT3L) C-terminal domain, a KRAB domain (e.g., KOX1 or ZIM3 KRAB domain), and a H3K4me0 (e.g., a 12-aa or a 30-aa N-terminal fragment of SEQ ID NO:393, 394, 395 or 396, such as the sequence set forth in SEQ ID NO:81 or 87).

In some embodiments, a fusion protein comprises, from N-terminus to C-terminus:
a) a H3K4me0 (e.g., a 12-aa or a 30-aa N-terminal fragment of SEQ ID NO:393, 394, 395 or 396, such as the sequence set forth in SEQ ID NO:81 or 87), a KRAB domain (e.g., KOX1 or ZIM3 KRAB domain), a DNMT3 methyltransferase-binding domain (e.g., a Dnmt3L C-terminal domain), and a TALE; or
b) a TALE, a DNMT3 methyltransferase-binding domain (e.g., a Dnmt3L C-terminal domain), a KRAB domain (e.g., KOX1 or ZIM3 KRAB domain), and a H3K4me0 (e.g., a 12-aa or a 30-aa N-terminal fragment of SEQ ID NO:393, 394, 395 or 396, such as the sequence set forth in SEQ ID NO:81 or 87).

In some embodiments, a fusion protein comprises, from N-terminus to C-terminus:
a) a H3K4me0 (e.g., a 12-aa or a 30-aa N-terminal fragment of SEQ ID NO:393, 394, 395 or 396, such as the sequence set forth in SEQ ID NO:81 or 87), a KRAB domain (e.g., KOX1 or ZIM3 KRAB domain), a Dnmt3L (e.g., *Mus musculus* or *Apodemus sylvaticus* DNMT3L) C-terminal domain, and a TALE; or
b) a TALE, a Dnmt3L (e.g., *Mus musculus* or *Apodemus sylvaticus* DNMT3L) C-terminal domain, a KRAB domain (e.g., KOX1 or ZIM3 KRAB domain), and a H3K4me0 (e.g., a 12-aa or a 30-aa N-terminal fragment of SEQ ID NO:393, 394, 395 or 396, such as the sequence set forth in SEQ ID NO:81 or 87).

In some embodiments, a fusion protein comprises, from N-terminus to C-terminus, a H3K4me0 (e.g., a 12-aa or a 30-aa N-terminal fragment of SEQ ID NO:393, 394, 395 or 396, such as the sequence set forth in SEQ ID NO:81 or 87), a KRAB domain (e.g., KOX1 or ZIM3 KRAB domain), a DNMT3 methyltransferase-binding domain (e.g., a Dnmt3L C-terminal domain), and a DNA-binding domain (e.g., Cas (e.g., *Staphylococcus aureus* dCas9, *Streptococcus pyogenes* dCas9, *S. aureus* dCas9, dCas12a or dCas12f), ZFP or TALE).

In some embodiments, a fusion protein comprises, from N-terminus to C-terminus, a H3K4me0 (e.g., a 12-aa or a 30-aa N-terminal fragment of SEQ ID NO:393, 394, 395 or 396, such as the sequence set forth in SEQ ID NO:81 or 87), a KRAB domain (e.g., KOX1 or ZIM3 KRAB domain), a Dnmt3L (e.g., *Mus musculus* or *Apodemus sylvaticus* DNMT3L) C-terminal domain, and a DNA-binding domain (e.g., Cas (e.g., *Staphylococcus aureus* dCas9, *Streptococcus pyogenes* dCas9, *S. aureus* dCas9, dCas12a or dCas12f), ZFP or TALE).

In some embodiments, a fusion protein comprises, from N-terminus to C-terminus, a H3K4me0 (e.g., a 12-aa or a 30-aa N-terminal fragment of SEQ ID NO:393, 394, 395 or 396, such as the sequence set forth in SEQ ID NO:81 or 87), a KRAB domain (e.g., KOX1 or ZIM3 KRAB domain), a DNMT3 methyltransferase-binding domain (e.g., a Dnmt3L C-terminal domain), and a Cas (e.g., *Staphylococcus aureus* dCas9, *Streptococcus pyogenes* dCas9, *S. aureus* dCas9, dCas12a or dCas12f).

In some embodiments, a fusion protein comprises, from N-terminus to C-terminus, a H3K4me0 (e.g., a 12-aa or a 30-aa N-terminal fragment of SEQ ID NO:393, 394, 395 or 396, such as the sequence set forth in SEQ ID NO:81 or 87), a KRAB domain (e.g., KOX1 or ZIM3 KRAB domain), a Dnmt3L (e.g., *Mus musculus* or *Apodemus sylvaticus* DNMT3L) C-terminal domain, and a Cas (e.g., *Staphylococcus aureus* dCas9, *Streptococcus pyogenes* dCas9, *S. aureus* dCas9, dCas12a or dCas12f).

In some embodiments, a fusion protein comprises, from N-terminus to C-terminus, a H3K4me0 (e.g., a 12-aa or a 30-aa N-terminal fragment of SEQ ID NO:393, 394, 395 or 396, such as the sequence set forth in SEQ ID NO:81 or 87), a KRAB domain (e.g., KOX1 or ZIM3 KRAB domain), a DNMT3 methyltransferase-binding domain (e.g., a Dnmt3L C-terminal domain), and a ZFP.

In some embodiments, a fusion protein comprises, from N-terminus to C-terminus, a H3K4me0 (e.g., a 12-aa or a 30-aa N-terminal fragment of SEQ ID NO:393, 394, 395 or 396, such as the sequence set forth in SEQ ID NO:81 or 87), a KRAB domain (e.g., KOX1 or ZIM3 KRAB domain), a Dnmt3L (e.g., *Mus musculus* or *Apodemus sylvaticus* DNMT3L) C-terminal domain, and a ZFP.

In some embodiments, a fusion protein comprises, from N-terminus to C-terminus, a H3K4me0 (e.g., a 12-aa or a 30-aa N-terminal fragment of SEQ ID NO:393, 394, 395 or 396, such as the sequence set forth in SEQ ID NO:81 or 87), a KRAB domain (e.g., KOX1 or ZIM3 KRAB domain), a DNMT3 methyltransferase-binding domain (e.g., a Dnmt3L C-terminal domain), and a TALE.

In some embodiments, a fusion protein comprises, from N-terminus to C-terminus, a H3K4me0 (e.g., a 12-aa or a 30-aa N-terminal fragment of SEQ ID NO:393, 394, 395 or 396, such as the sequence set forth in SEQ ID NO:81 or 87), a KRAB domain (e.g., KOX1 or ZIM3 KRAB domain), a Dnmt3L (e.g., *Mus musculus* or *Apodemus sylvaticus* DNMT3L) C-terminal domain, and a TALE.

In some embodiments, a fusion protein comprises, from N-terminus to C-terminus, a DNA-binding domain (e.g., Cas (e.g., *Staphylococcus aureus* dCas9, *Streptococcus pyogenes* dCas9, *S. aureus* dCas9, dCas12a or dCas12f), ZFP or TALE), a DNMT3 methyltransferase-binding domain (e.g., a Dnmt3L C-terminal domain), a KRAB domain (e.g., KOX1 or ZIM3 KRAB domain), and a H3K4me0 (e.g., a 12-aa or a 30-aa N-terminal fragment of SEQ ID NO:393, 394, 395 or 396, such as the sequence set forth in SEQ ID NO:81 or 87).

In some embodiments, a fusion protein comprises, from N-terminus to C-terminus, a DNA-binding domain (e.g., Cas (e.g., *Staphylococcus aureus* dCas9, *Streptococcus pyogenes* dCas9, *S. aureus* dCas9, dCas12a or dCas12f), ZFP or TALE), a Dnmt3L (e.g., *Mus musculus* or *Apodemus sylvaticus* DNMT3L) C-terminal domain, a KRAB domain (e.g., KOX1 or ZIM3 KRAB domain), and a H3K4me0 (e.g., a 12-aa or a 30-aa N-terminal fragment of SEQ ID NO:393, 394, 395 or 396, such as the sequence set forth in SEQ ID NO:81 or 87).

In some embodiments, a fusion protein comprises, from N-terminus to C-terminus, a Cas (e.g., *Staphylococcus aureus* dCas9, *Streptococcus pyogenes* dCas9, *S. aureus* dCas9, dCas12a or dCas12f), a DNMT3 methyltransferase-binding domain (e.g., a Dnmt3L C-terminal domain), a KRAB domain (e.g., KOX1 or ZIM3 KRAB domain), and a H3K4me0 (e.g., a 12-aa or a 30-aa N-terminal fragment of SEQ ID NO:393, 394, 395 or 396, such as the sequence set forth in SEQ ID NO:81 or 87).

In some embodiments, a fusion protein comprises, from N-terminus to C-terminus, a Cas (e.g., *Staphylococcus aureus* dCas9, *Streptococcus pyogenes* dCas9, *S. aureus* dCas9, dCas12a or dCas12f), a Dnmt3L (e.g., *Mus musculus* or *Apodemus sylvaticus* DNMT3L) C-terminal domain, a KRAB domain (e.g., KOX1 or ZIM3 KRAB domain), and a H3K4me0 (e.g., a 12-aa or a 30-aa N-terminal fragment of SEQ ID NO:393, 394, 395 or 396, such as the sequence set forth in SEQ ID NO:81 or 87).

In some embodiments, a fusion protein comprises, from N-terminus to C-terminus, a ZFP, a DNMT3 methyltransferase-binding domain (e.g., a Dnmt3L C-terminal domain), a KRAB domain (e.g., KOX1 or ZIM3 KRAB domain), and a H3K4me0 (e.g., a 12-aa or a 30-aa N-terminal fragment of SEQ ID NO:393, 394, 395 or 396, such as the sequence set forth in SEQ ID NO:81 or 87).

In some embodiments, a fusion protein comprises, from N-terminus to C-terminus, a ZFP, a Dnmt3L (e.g., *Mus musculus* or *Apodemus sylvaticus* DNMT3L) C-terminal domain, a KRAB domain (e.g., KOX1 or ZIM3 KRAB domain), and a H3K4me0 (e.g., a 12-aa or a 30-aa N-terminal fragment of SEQ ID NO:393, 394, 395 or 396, such as the sequence set forth in SEQ ID NO:81 or 87).

In some embodiments, a fusion protein comprises, from N-terminus to C-terminus, a TALE, a DNMT3 methyltransferase-binding domain (e.g., a Dnmt3L C-terminal domain), a KRAB domain (e.g., KOX1 or ZIM3 KRAB domain), and a H3K4me0 (e.g., a 12-aa or a 30-aa N-terminal fragment of SEQ ID NO:393, 394, 395 or 396, such as the sequence set forth in SEQ ID NO:81 or 87).

In some embodiments, a fusion protein comprises, from N-terminus to C-terminus, a TALE, a Dnmt3L (e.g., *Mus musculus* or *Apodemus sylvaticus* DNMT3L) C-terminal domain, a KRAB domain (e.g., KOX1 or ZIM3 KRAB domain), and a H3K4me0 (e.g., a 12-aa or a 30-aa N-terminal fragment of SEQ ID NO:393, 394, 395 or 396, such as the sequence set forth in SEQ ID NO:81 or 87).

In some embodiments, a fusion protein comprises, from N-terminus to C-terminus, a DNMT3 methyltransferase-binding domain (e.g., a Dnmt3L C-terminal domain), a KRAB domain (e.g., KOX1 or ZIM3 KRAB domain), a H3K4me0 (e.g., a 12-aa or a 30-aa N-terminal fragment of SEQ ID NO:393, 394, 395 or 396, such as the sequence set forth in SEQ ID NO:81 or 87), and a DNA-binding domain (e.g., Cas (e.g., *Staphylococcus aureus* dCas9, *Streptococcus pyogenes* dCas9, *S. aureus* dCas9, dCas12a or dCas12f), ZFP or TALE).

In some embodiments, a fusion protein comprises, from N-terminus to C-terminus, a Dnmt3L (e.g., *Mus musculus* or *Apodemus sylvaticus* DNMT3L) C-terminal domain, a KRAB domain (e.g., KOX1 or ZIM3 KRAB domain), a H3K4me0 (e.g., a 12-aa or a 30-aa N-terminal fragment of SEQ ID NO:393, 394, 395 or 396, such as the sequence set forth in SEQ ID NO:81 or 87), and a DNA-binding domain (e.g., Cas (e.g., *Staphylococcus aureus* dCas9, *Streptococcus pyogenes* dCas9, *S. aureus* dCas9, dCas12a or dCas12f), ZFP or TALE).

In some embodiments, a fusion protein comprises, from N-terminus to C-terminus, a DNMT3 methyltransferase-binding domain (e.g., a Dnmt3L C-terminal domain), a KRAB domain (e.g., KOX1 or ZIM3 KRAB domain), a H3K4me0 (e.g., a 12-aa or a 30-aa N-terminal fragment of SEQ ID NO:393, 394, 395 or 396, such as the sequence set forth in SEQ ID NO:81 or 87), and a Cas (e.g., *Staphylococcus aureus* dCas9, *Streptococcus pyogenes* dCas9, *S. aureus* dCas9, dCas12a or dCas12f).

In some embodiments, a fusion protein comprises, from N-terminus to C-terminus, a Dnmt3L (e.g., *Mus musculus* or *Apodemus sylvaticus* DNMT3L) C-terminal domain, a KRAB domain (e.g., KOX1 or ZIM3 KRAB domain), a H3K4me0 (e.g., a 12-aa or a 30-aa N-terminal fragment of SEQ ID NO:393, 394, 395 or 396, such as the sequence set forth in SEQ ID NO:81 or 87), and a Cas (e.g., *Staphylococcus aureus* dCas9, *Streptococcus pyogenes* dCas9, *S. aureus* dCas9, dCas12a or dCas12f).

In some embodiments, a fusion protein comprises, from N-terminus to C-terminus, a DNMT3 methyltransferase-binding domain (e.g., a Dnmt3L C-terminal domain), a KRAB domain (e.g., KOX1 or ZIM3 KRAB domain), a H3K4me0 (e.g., a 12-aa or a 30-aa N-terminal fragment of SEQ ID NO:393, 394, 395 or 396, such as the sequence set forth in SEQ ID NO:81 or 87), and a ZFP.

In some embodiments, a fusion protein comprises, from N-terminus to C-terminus, a Dnmt3L (e.g., *Mus musculus* or *Apodemus sylvaticus* DNMT3L) C-terminal domain, a KRAB domain (e.g., KOX1 or ZIM3 KRAB domain), a H3K4me0 (e.g., a 12-aa or a 30-aa N-terminal fragment of SEQ ID NO:393, 394, 395 or 396, such as the sequence set forth in SEQ ID NO:81 or 87), and a ZFP.

In some embodiments, a fusion protein comprises, from N-terminus to C-terminus, a DNMT3 methyltransferase-binding domain (e.g., a Dnmt3L C-terminal domain), a KRAB domain (e.g., KOX1 or ZIM3 KRAB domain), a H3K4me0 (e.g., a 12-aa or a 30-aa N-terminal fragment of SEQ ID NO:393, 394, 395 or 396, such as the sequence set forth in SEQ ID NO:81 or 87), and a TALE.

In some embodiments, a fusion protein comprises, from N-terminus to C-terminus, a Dnmt3L (e.g., *Mus musculus* or *Apodemus sylvaticus* DNMT3L) C-terminal domain, a KRAB domain (e.g., KOX1 or ZIM3 KRAB domain), a H3K4me0 (e.g., a 12-aa or a 30-aa N-terminal fragment of SEQ ID NO:393, 394, 395 or 396, such as the sequence set forth in SEQ ID NO:81 or 87), and a TALE.

In some embodiments, a fusion protein comprises, from N-terminus to C-terminus, a DNA-binding domain (e.g., Cas (e.g., *Staphylococcus aureus* dCas9, *Streptococcus pyogenes* dCas9, *S. aureus* dCas9, dCas12a or dCas12f), ZFP or TALE), a H3K4me0 (e.g., a 12-aa or a 30-aa N-terminal fragment of SEQ ID NO:393, 394, 395 or 396, such as the sequence set forth in SEQ ID NO:81 or 87), a KRAB domain (e.g., KOX1 or ZIM3 KRAB domain), and a DNMT3 methyltransferase-binding domain (e.g., a Dnmt3L C-terminal domain).

In some embodiments, a fusion protein comprises, from N-terminus to C-terminus, a DNA-binding domain (e.g., Cas (e.g., *Staphylococcus aureus* dCas9, *Streptococcus pyogenes* dCas9, *S. aureus* dCas9, dCas12a or dCas12f), ZFP or TALE), a H3K4me0 (e.g., a 12-aa or a 30-aa N-terminal fragment of SEQ ID NO:393, 394, 395 or 396, such as the sequence set forth in SEQ ID NO:81 or 87), a KRAB domain (e.g., KOX1 or ZIM3 KRAB domain), and a Dnmt3L (e.g., *Mus musculus* or *Apodemus sylvaticus* DNMT3L) C-terminal domain.

In some embodiments, a fusion protein comprises, from N-terminus to C-terminus, a Cas (e.g., *Staphylococcus aureus* dCas9, *Streptococcus pyogenes* dCas9, *S. aureus* dCas9, dCas12a or dCas12f), a H3K4me0 (e.g., a 12-aa or a 30-aa N-terminal fragment of SEQ ID NO:393, 394, 395 or 396, such as the sequence set forth in SEQ ID NO:81 or 87), a KRAB domain (e.g., KOX1 or ZIM3 KRAB domain), and a DNMT3 methyltransferase-binding domain (e.g., a Dnmt3L C-terminal domain).

In some embodiments, a fusion protein comprises, from N-terminus to C-terminus, a Cas (e.g., *Staphylococcus aureus* dCas9, *Streptococcus pyogenes* dCas9, *S. aureus* dCas9, dCas12a or dCas12f), a H3K4me0 (e.g., a 12-aa or a 30-aa N-terminal fragment of SEQ ID NO:393, 394, 395 or 396, such as the sequence set forth in SEQ ID NO:81 or 87), a KRAB domain (e.g., KOX1 or ZIM3 KRAB domain), and a Dnmt3L (e.g., *Mus musculus* or *Apodemus sylvaticus* DNMT3L) C-terminal domain.

In some embodiments, a fusion protein comprises, from N-terminus to C-terminus, a ZFP, a H3K4me0 (e.g., a 12-aa or a 30-aa N-terminal fragment of SEQ ID NO:393, 394, 395 or 396, such as the sequence set forth in SEQ ID NO:81 or 87), a KRAB domain (e.g., KOX1 or ZIM3 KRAB domain), and a DNMT3 methyltransferase-binding domain (e.g., a Dnmt3L C-terminal domain).

In some embodiments, a fusion protein comprises, from N-terminus to C-terminus, a ZFP, a H3K4me0 (e.g., a 12-aa or a 30-aa N-terminal fragment of SEQ ID NO:393, 394, 395 or 396, such as the sequence set forth in SEQ ID NO:81 or 87), a KRAB domain (e.g., KOX1 or ZIM3 KRAB domain), and a Dnmt3L (e.g., *Mus musculus* or *Apodemus sylvaticus* DNMT3L) C-terminal domain.

In some embodiments, a fusion protein comprises, from N-terminus to C-terminus, a TALE, a H3K4me0 (e.g., a 12-aa or a 30-aa N-terminal fragment of SEQ ID NO:393, 394, 395 or 396, such as the sequence set forth in SEQ ID NO:81 or 87), a KRAB domain (e.g., KOX1 or ZIM3 KRAB domain), and a DNMT3 methyltransferase-binding domain (e.g., a Dnmt3L C-terminal domain).

In some embodiments, a fusion protein comprises, from N-terminus to C-terminus, a TALE, a H3K4me0 (e.g., a 12-aa or a 30-aa N-terminal fragment of SEQ ID NO:393, 394, 395 or 396, such as the sequence set forth in SEQ ID NO:81 or 87), a KRAB domain (e.g., KOX1 or ZIM3 KRAB domain), and a Dnmt3L (e.g., *Mus musculus* or *Apodemus sylvaticus* DNMT3L) C-terminal domain.

In some embodiments, a fusion protein comprises, from N-terminus to C-terminus: a H3K4me0, a DNMT3 methyltransferase-binding domain, and a DNA-binding domain (e.g., dCas9, ZFP or TALE). In some embodiments, a fusion protein comprises, from N-terminus to C-terminus: a H3K4me0 (e.g., SEQ ID NO:87), a DNMT3 methyltransferase-binding domain, a DNA-binding domain (e.g., dCas9), and a KRAB domain. In some embodiments, a fusion protein comprises, from N-terminus to C-terminus: a H3K4me0 (e.g., SEQ ID NO:87), a KRAB domain, a DNMT3 methyltransferase-binding domain, and a DNA-binding domain (e.g., a dCas9).

In some embodiments, a fusion protein disclosed herein comprises, from N-terminus to C-terminus: a H3K4me0, a DNA-binding domain, and a DNMT3 methyltransferase-binding domain. In some embodiments, a fusion protein disclosed herein comprises, from N-terminus to C-terminus: a H3K4me0, a DNA-binding domain, a DNMT3 methyltransferase-binding domain, and a KRAB domain.

In some embodiments, a fusion protein comprises:
a) a H3K4me0 having at least about 80% sequence identity to at least one sequence set forth in SEQ ID NOs:81 and 87;
b) a Dnmt3L C-terminal domain having at least about 80% sequence identity to at least one sequence set forth in SEQ ID NOs:31-50 and 71-75; or
c) a dCas9 having at least about 80% sequence identity to the amino acid sequence set forth in SEQ ID NO:1, or any combination of the foregoing.

In some embodiments, a fusion protein comprises:
a) a H3K4me0 having 100% sequence identity to a sequence set forth in SEQ ID NOs:81 or 87;
b) a Dnmt3L C-terminal domain having 100% sequence identity to a sequence set forth in SEQ ID NOs:31-50 and 71-75; or
c) a dCas9 having 100% sequence identity to the amino acid sequence set forth in SEQ ID NO:1, or any combination of the foregoing.

In some embodiments, a fusion protein comprises:
a) a H3K4me0 having 80% sequence identity to the sequence set forth in SEQ ID NO:81;
b) a Dnmt3L C-terminal domain having 80% sequence identity to the sequence set forth in SEQ ID NO:31, SEQ ID NO:32, or SEQ ID NO:38; or
c) a dCas9 having 80% sequence identity to the amino acid sequence set forth in SEQ ID NO:1, or any combination of the foregoing.

In some embodiments, a fusion protein comprises:
a) a H3K4me0 having 100% sequence identity to the sequence set forth in SEQ ID NO:81;
b) a Dnmt3L C-terminal domain having 100% sequence identity to the sequence set forth in SEQ ID NO:31, SEQ ID NO:32, or SEQ ID NO:38; or
c) a dCas9 having 100% sequence identity to the amino acid sequence set forth in SEQ ID NO:1, or any combination of the foregoing.

In some embodiments, a fusion protein comprises:
a) a H3K4me0 having at least about 80% sequence identity to the sequence set forth in SEQ ID NO:87;
b) a Dnmt3L C-terminal domain having at least about 80% sequence identity to the sequence set forth in SEQ ID NO:32; or
c) a dCas9 having at least about 80% sequence identity to the amino acid sequence set forth in SEQ ID NO:1, or any combination of the foregoing.

In some embodiments, a fusion protein comprises:
a) a H3K4me0 having 100% sequence identity to the sequence set forth in SEQ ID NO:87;
b) a Dnmt3L C-terminal domain having 100% sequence identity to the sequence set forth in SEQ ID NO:32; or
c) a dCas9 having 100% sequence identity to the amino acid sequence set forth in SEQ ID NO:1,
d) or any combination of the foregoing.

In some embodiments, a fusion protein comprises:
a) a H3K4me0 having at least 80% sequence identity to at least one sequence set forth in SEQ ID NO:87, SEQ ID NO:81, and SEQ ID NOs:393-396;
b) a DNMT3 methyltransferase-binding domain having at least 80% sequence identity to at least one sequence set forth in SEQ ID NOs:31-50 and 71-75;
c) a DNA-binding domain having at least 80% sequence identity to at least one sequence set forth in SEQ ID NO:1, SEQ ID NO:489, SEQ ID NOs:3-15, SEQ ID NOs:454-469;
d) a KRAB domain having at least 80% sequence identity to SEQ ID NO:155, or any combination of the foregoing.

In some embodiments, a fusion protein comprises:
a) a H3K4me0 having 100% sequence identity to a sequence set forth in SEQ ID NO:87, SEQ ID NO:81, and SEQ ID NOs:393-396;
b) a DNMT3 methyltransferase-binding domain having 100% sequence identity to a sequence set forth in SEQ ID NOs:31-50 and 71-75;
c) a DNA-binding domain having 100% sequence identity to a sequence set forth in SEQ ID NO:1, SEQ ID NO:489, SEQ ID NOs:3-15, and SEQ ID NOs:454-469;
d) a KRAB domain having 100% sequence identity to SEQ ID NO:155, or any combination of the foregoing.

In some embodiments, a fusion protein comprises:
a) a H3K4me0 having at least 80% sequence identity to at least one sequence set forth in SEQ ID NO:87, SEQ ID NO:81, and SEQ ID NOs:393-396;
b) a DNMT3 methyltransferase-binding domain having at least 80% sequence identity to at least one sequence set forth in SEQ ID NOs:31-50 and 71-75;
c) a DNA-binding domain having at least 80% sequence identity to at least one sequence set forth in SEQ ID NO:1, SEQ ID NO:489, SEQ ID NOs:3-9, and SEQ ID NOs:454-461;
d) a KRAB domain having at least 80% sequence identity to SEQ ID NO:155, or any combination of the foregoing.

In some embodiments, a fusion protein comprises:
a) a H3K4me0 having 100% sequence identity to a sequence set forth in SEQ ID NO:87, SEQ ID NO:81, and SEQ ID NOs:393-396;
b) a DNMT3 methyltransferase-binding domain having 100% sequence identity to a sequence set forth in SEQ ID NOs:31-50 and 71-75;
c) a DNA-binding domain having 100% sequence identity to a sequence set forth in SEQ ID NO:1, SEQ ID NO:489, SEQ ID NOs:3-9, and SEQ ID NOs:454-461;
d) a KRAB domain having 100% sequence identity to SEQ ID NO:155, or any combination of the foregoing.

In some embodiments, a fusion protein comprises:
a) a H3K4me0 having at least 80% sequence identity to at least one sequence set forth in SEQ ID NO:87, SEQ ID NO:81, and SEQ ID NOs:393-396;
b) a DNMT3 methyltransferase-binding domain having at least 80% sequence identity to at least one sequence set forth in SEQ ID NOs:31-50 and 71-75;
c) a DNA-binding domain having at least 80% sequence identity to at least one sequence set forth in SEQ ID NO:1, SEQ ID NO:489, SEQ ID NOs:3-15, SEQ ID NOs:454-469, or any combination of the foregoing, wherein the fusion protein does not comprise a KRAB domain.

In some embodiments, a fusion protein comprises:
a) a H3K4me0 having 100% sequence identity to a sequence set forth in SEQ ID NO:87, SEQ ID NO:81, and SEQ ID NOs:393-396;
b) a DNMT3 methyltransferase-binding domain having 100% sequence identity to a sequence set forth in SEQ ID NOs:31-50 and 71-75;
c) a DNA-binding domain having 100% sequence identity to a sequence set forth in SEQ ID NO:1, SEQ ID NO:489, SEQ ID NOs:3-15, and SEQ ID NOs:454-469, or any combination of the foregoing, wherein the fusion protein does not comprise a KRAB domain.

In some embodiments, a fusion protein comprises:
a) a H3K4me0 having at least 80% sequence identity to at least one sequence set forth in SEQ ID NO:87, SEQ ID NO:81, and SEQ ID NOs:393-396;
b) a DNMT3 methyltransferase-binding domain having at least 80% sequence identity to at least one sequence set forth in SEQ ID NOs:31-50 and 71-75;
c) a DNA-binding domain having at least 80% sequence identity to at least one sequence set forth in SEQ ID NO:1, SEQ ID NO:489, SEQ ID NOs:3-9, and SEQ ID NOs:454-461,
or any combination of the foregoing, wherein the fusion protein does not comprise a KRAB domain.

In some embodiments, a fusion protein comprises:
a) a H3K4me0 having 100% sequence identity to a sequence set forth in SEQ ID NO:87, SEQ ID NO:81, and SEQ ID NOs:393-396;
b) a DNMT3 methyltransferase-binding domain having 100% sequence identity to a sequence set forth in SEQ ID NOs:31-50 and 71-75;
c) a DNA-binding domain having 100% sequence identity to a sequence set forth in SEQ ID NO:1, SEQ ID NO:489, SEQ ID NOs:3-9, and SEQ ID NOs:454-461;
or any combination of the foregoing, wherein the fusion protein does not comprise a KRAB domain.

In some embodiments, a fusion protein comprises:
a) a H3K4me0 having at least 80% sequence identity to SEQ ID NO:87;
b) a DNMT3 methyltransferase-binding domain having at least 80% sequence identity to SEQ ID NOs:31;
c) a DNA-binding domain having at least 80% sequence identity to SEQ ID NO:1;
d) a KRAB domain having at least 80% sequence identity to SEQ ID NO:155,
or any combination of the foregoing.

In some embodiments, a fusion protein comprises:
a) a H3K4me0 having 100% sequence identity to SEQ ID NO:87;
b) a DNMT3 methyltransferase-binding domain having 100% sequence identity to SEQ ID NOs:31;
c) a DNA-binding domain having 100% sequence identity to SEQ ID NO:1;
d) a KRAB domain having 100% sequence identity to SEQ ID NO:155, or any combination of the foregoing.

In some embodiments, a fusion protein comprises:
a) a H3K4me0 having at least 80% sequence identity to SEQ ID NO:87;
b) a DNMT3 methyltransferase-binding domain having at least 80% sequence identity to SEQ ID NOs:31;
c) a DNA-binding domain having at least 80% sequence identity to SEQ ID NO:1, or any combination of the foregoing, wherein the fusion protein does not comprise a KRAB domain.

In some embodiments, a fusion protein comprises:
a) a H3K4me0 having 100% sequence identity to SEQ ID NO:87;
b) a DNMT3 methyltransferase-binding domain having 100% sequence identity to SEQ ID NOs:31;
c) a DNA-binding domain having 100% sequence identity to SEQ ID NO:1, or any combination of the foregoing, wherein the fusion protein does not comprise a KRAB domain.

In some embodiments, a fusion protein comprises:
a) a H3K4me0 having at least 80% sequence identity to SEQ ID NO:87;
b) a DNMT3 methyltransferase-binding domain having at least 80% sequence identity to SEQ ID NOs:31;
c) a DNA-binding domain having at least 80% sequence identity to SEQ ID NO:489;
d) a KRAB domain having at least 80% sequence identity to SEQ ID NO:155, or any combination of the foregoing.

In some embodiments, a fusion protein comprises:
a) a H3K4me0 having 100% sequence identity to SEQ ID NO:87;
b) a DNMT3 methyltransferase-binding domain having 100% sequence identity to SEQ ID NOs:31;
c) a DNA-binding domain having 100% sequence identity to SEQ ID NO:489;
d) a KRAB domain having 100% sequence identity to SEQ ID NO:155, or any combination of the foregoing.

In some embodiments, a fusion protein comprises:
a) a H3K4me0 having at least 80% sequence identity to SEQ ID NO:87;
b) a DNMT3 methyltransferase-binding domain having at least 80% sequence identity to SEQ ID NOs:31;
c) a DNA-binding domain having at least 80% sequence identity to SEQ ID NO:489, or any combination of the foregoing, wherein the fusion protein does not comprise a KRAB domain.

In some embodiments, a fusion protein comprises:
a) a H3K4me0 having 100% sequence identity to SEQ ID NO:87;
b) a DNMT3 methyltransferase-binding domain having 100% sequence identity to SEQ ID NOs:31;
c) a DNA-binding domain having 100% sequence identity to SEQ ID NO:489, or any combination of the foregoing, wherein the fusion protein does not comprise a KRAB domain.

In some embodiments, a fusion protein comprises:
a) a H3K4me0 having at least 80% sequence identity to SEQ ID NO:87;
b) a DNMT3 methyltransferase-binding domain having at least 80% sequence identity to SEQ ID NOs:31;
c) a DNA-binding domain having at least 80% sequence identity to SEQ ID NO:458;
d) a KRAB domain having at least 80% sequence identity to SEQ ID NO:155, or any combination of the foregoing.

In some embodiments, a fusion protein comprises:
a) a H3K4me0 having 100% sequence identity to SEQ ID NO:87;
b) a DNMT3 methyltransferase-binding domain having 100% sequence identity to SEQ ID NOs:31;
c) a DNA-binding domain having 100% sequence identity to SEQ ID NO:458;
d) a KRAB domain having 100% sequence identity to SEQ ID NO:155, or any combination of the foregoing.

In some embodiments, a fusion protein comprises:
a) a H3K4me0 having at least 80% sequence identity to SEQ ID NO:87;
b) a DNMT3 methyltransferase-binding domain having at least 80% sequence identity to SEQ ID NOs:31;
c) a DNA-binding domain having at least 80% sequence identity to SEQ ID NO:458, or any combination of the foregoing, wherein the fusion protein does not comprise a KRAB domain.

In some embodiments, a fusion protein comprises:
a) a H3K4me0 having 100% sequence identity to SEQ ID NO:87;
b) a DNMT3 methyltransferase-binding domain having 100% sequence identity to SEQ ID NOs:31;
c) a DNA-binding domain having 100% sequence identity to SEQ ID NO:458, or any combination of the foregoing, wherein the fusion protein does not comprise a KRAB domain.

In some embodiments, a H3K4me0 and a DNMT3 methyltransferase-binding domain (e.g., a Dnmt3L C-terminal domain) are operatively linked by a linker described herein. In some embodiments, a DNMT3 methyltransferase-binding domain (e.g., a Dnmt3L C-terminal domain) and a DNA-binding domain (e.g., dCas9 or ZFP) are operatively linked by a linker described herein. In some embodiments, a DNA-binding domain (e.g., dCas9 or ZFP) and a H3K4me0 are operatively linked by a linker described herein.

In some embodiments, a fusion protein comprises an amino acid sequence having at least about 80% sequence identity to at least one sequence set forth in SEQ ID NOs:157-169, 397, 398, and 470-488, for example, has at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to at least one sequence set forth in SEQ ID NOs:157-169, 397, 398, and 470-488. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to at least one sequence set forth in SEQ ID NOs:157-169, 397, 398, and 470-488. In some embodiments, a fusion protein comprises an amino acid sequence having 100% sequence identity to a sequence set forth in SEQ ID NOs: 157-169, 397, 398, and 470-488.

In some embodiments, a fusion protein comprises an amino acid sequence having at least about 80% sequence identity to at least one sequence set forth in SEQ ID NOs:157-162, 397, 398, and 470-488, for example, has at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to at least one sequence set forth in SEQ ID NOs:157-162, 397, 398, and 470-488. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to at least one sequence set forth in SEQ ID NOs:157-162, 397, 398, and 470-488. In some embodiments, a fusion protein comprises an amino acid sequence having 100% sequence identity to a sequence set forth in SEQ ID NOs: 157-162, 397, 398, and 470-488.

In some embodiments, a fusion protein comprises an amino acid sequence having at least about 80% sequence identity to at least one sequence set forth in SEQ ID NOs:157, 160, 162, 397, 398, and 470-488, for example, has at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to at least one sequence set forth in SEQ ID NOs:157, 160, 162, 397, 398, and 470-488. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to at least one sequence set forth in SEQ ID NOs:157, 160, 162, 397, 398, and 470-488. In some embodiments, a fusion protein comprises an amino acid sequence having 100% sequence identity to a sequence set forth in SEQ ID NOs: 157, 160, 162, 397, 398, and 470-488.

In some embodiments, a fusion protein comprises an amino acid sequence having at least about 80% sequence identity to at least one sequence set forth in SEQ ID NOs:157-169, 397 and 398, for example, has at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to at least one sequence set forth in SEQ ID NOs:157-169, 397 and 398. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to at least one sequence set forth in SEQ ID NOs:157-169, 397 and 398. In some embodiments, a fusion protein comprises an amino acid sequence having 100% sequence identity to a sequence set forth in SEQ ID NOs:157-169, 397 and 398.

In some embodiments, a fusion protein comprises an amino acid sequence having at least about 80% sequence identity to at least one sequence set forth in SEQ ID NOs:157-162, 397 and 398, for example, has at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to at least one sequence set forth in SEQ ID NOs:157-162, 397 and 398. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to at least one sequence set forth in SEQ ID NOs:157-162, 397 and 398. In some embodiments, a fusion protein comprises an amino acid sequence having 100% sequence identity to a sequence set forth in SEQ ID NOs:157-162, 397 and 398.

In some embodiments, a fusion protein comprises an amino acid sequence having at least about 80% sequence identity to at least one sequence set forth in SEQ ID NOs:157, 160, 162, 397 and 398, for example, has at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to at least one sequence set forth in SEQ ID NOs:157, 160, 162, 397 and 398. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to at least one sequence set forth in SEQ ID NOs:157, 160, 162, 397 and 398. In some embodiments, a fusion protein comprises an amino acid sequence having 100% sequence identity to a sequence set forth in SEQ ID NOs:157, 160, 162, 397 and 398.

In some embodiments, a fusion protein comprises an amino acid sequence having at least about 80% sequence identity to the amino acid sequence set forth in SEQ ID NO:397, for example, has at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to the sequence set forth in SEQ ID NO:397. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to the sequence set forth in SEQ ID NO:397. In some embodiments, a fusion protein comprises an amino acid sequence having 100% sequence identity to the sequence set forth in SEQ ID NO:397.

In some embodiments, a fusion protein comprises an amino acid sequence having at least about 80% sequence identity to the amino acid sequence set forth in SEQ ID NO:398, for example, has at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to the sequence set forth in SEQ ID NO:398. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to the sequence set forth in SEQ ID NO:398. In some embodiments, a fusion protein comprises an amino acid sequence having 100% sequence identity to the sequence set forth in SEQ ID NO:398.

In some embodiments, a fusion protein comprises an amino acid sequence having at least about 80% sequence identity to at least one sequence set forth in SEQ ID NOs:158, 159 and 161, for example, has at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to at least one sequence set forth in SEQ ID NOs:158, 159 and 161. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to at least one sequence set forth in SEQ ID NOs:158, 159 and 161. In some embodiments, a fusion protein comprises an amino acid sequence having 100% sequence identity to a sequence set forth in SEQ ID NOs:158, 159 and 161.

In some embodiments, a fusion protein comprises an amino acid sequence having at least about 80% sequence identity to at least one sequence set forth in SEQ ID NOs:163-169, for example, has at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to at least one sequence set forth in SEQ ID NOs:163-169. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to at least one sequence set forth in SEQ ID NOs:163-169. In some embodiments, a fusion protein comprises an amino acid sequence having 100% sequence identity to a sequence set forth in SEQ ID NOs:163-169.

In some embodiments, a fusion protein comprises an amino acid sequence having at least about 80% sequence identity to at least one sequence set forth in SEQ ID NOs:164-169, for example, has at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to at least one sequence set forth in SEQ ID NOs:164-169. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to at least one sequence set forth in SEQ ID NOs:164-169. In some embodiments, a fusion protein comprises an amino acid sequence having 100% sequence identity to a sequence set forth in SEQ ID NOs:164-169.

In some embodiments, a fusion protein comprises an amino acid sequence having at least about 80% sequence identity to the amino acid sequence set forth in SEQ ID NO:163, for example, has at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to the sequence set forth in SEQ ID NO:163. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to the sequence set forth in SEQ ID NO:163. In some embodiments, a fusion protein comprises an amino acid sequence having 100% sequence identity to the sequence set forth in SEQ ID NO:163.

In some embodiments, a fusion protein comprises an amino acid sequence having at least about 80% sequence identity to at least one sequence set forth in SEQ ID NOs:470-487, for example, has at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to at least one sequence set forth in SEQ ID NOs:470-487. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to at least one sequence set forth in SEQ ID NOs:470-487. In some embodiments, a fusion protein comprises an amino acid sequence having 100% sequence identity to a sequence set forth in SEQ ID NOs:470-487.

In some embodiments, a fusion protein comprises an amino acid sequence having at least about 80% sequence identity to at least one sequence set forth in SEQ ID NOs:470-477, for example, has at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to at least one sequence set forth in SEQ ID NOs:470-477. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to at least one sequence set forth in SEQ ID NOs:470-477. In some embodiments, a fusion protein comprises an amino acid sequence having 100% sequence identity to a sequence set forth in SEQ ID NOs:470-477.

In some embodiments, a fusion protein comprises an amino acid sequence having at least about 80% sequence identity to at least one sequence set forth in SEQ ID NOs:478-487, for example, has at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to at least one sequence set forth in SEQ ID NOs:478-487. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to at least one sequence set forth in SEQ ID NOs:478-487. In some embodiments, a fusion protein comprises an amino acid sequence having 100% sequence identity to a sequence set forth in SEQ ID NOs:478-487.

In some embodiments, a fusion protein comprises an amino acid sequence having at least about 80% sequence identity to the amino acid sequence set forth in SEQ ID NO:474, for example, has at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to the sequence set forth in SEQ ID NO:474. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to the sequence set forth in SEQ ID NO:474. In some embodiments, a fusion protein comprises an amino acid sequence having 100% sequence identity to the sequence set forth in SEQ ID NO:474.

In some embodiments, a fusion protein comprises an amino acid sequence having at least about 80% sequence identity to the amino acid sequence set forth in SEQ ID NO:488, for example, has at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to the sequence set forth in SEQ ID NO:488. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to the sequence set forth in SEQ ID NO:488. In some embodiments, a fusion protein comprises an amino acid sequence having 100% sequence identity to the sequence set forth in SEQ ID NO:488.

In some embodiments, a fusion protein further comprises a tag and/or a reporter, for example, a blue fluorescent protein (e.g., SEQ ID NO:153).

In some embodiments, a fusion protein lacks nuclease activity, or DNA methyltransferase activity, or both. In some embodiments, a fusion protein lacks nuclease activity. In some embodiments, a fusion protein lacks DNA methyltransferase activity. In some embodiments, a fusion protein lacks nuclease activity and DNA methyltransferase activity.

In some embodiments, a fusion protein lacks a DNA methyltransferase catalytic domain. In some embodiments, a fusion protein lacks a DNA methyltransferase catalytic domain, for example, a catalytic domain of DNMT3A, DNMT3B, or DNMT3C. In some embodiments, a fusion protein lacks a catalytic domain of DNMT3A. In some embodiments, a fusion protein lacks a Krüppel-associated box domain. In some embodiments, a fusion protein lacks a DNA methyltransferase catalytic domain, and a Krüppel-associated box domain.

In some embodiments, a fusion protein further comprises additional histone H3 amino acid sequences (i.e., beyond H3K4me0).

Polynucleotides

Also provided herein, among other things, is a polynucleotide encoding any one of the fusion proteins disclosed herein.

In some embodiments, a polynucleotide is a DNA.

In some embodiments, a polynucleotide is an mRNA. In some embodiments, an mRNA is in vitro transcribed (e.g., using a kit such as the MEGAscript™ T7 Transcription Kit (Invitrogen™AM1334)) from a DNA template. In some embodiments, an in vitro transcribed mRNA is modified to increase stability and/or to reduce immunogenicity, for example, by adding a 5' cap and/or substituting one or more nucleotides (e.g., substituting a UTP solution with N1-Methylpseudouridine-5'-Triphosphate). For additional information on in vitro transcription and mRNA production, see, e.g., Neugebauer et al., Evolution of an adenine base editor into a small, efficient cytosine base editor with low off-target activity, Nat Biotechnol. 41(5):673-85 (2023), the entire contents of which are incorporated herein by reference.

Also provided herein, among other things, is a polynucleotide comprising a nucleotide sequence encoding a DNA-binding domain, a nucleotide sequence encoding a DNMT3A-binding domain, and a nucleotide sequence encoding a H3K4me0.

Also provided herein, among other things, is a polynucleotide comprising a nucleotide sequence encoding a nuclease sequence (a nuclease-deficient nuclease), a nucleotide sequence encoding a DNMT3A-binding domain, and a nucleotide sequence encoding a H3K4me0.

In some embodiments, a polynucleotide further comprises a nucleotide sequence encoding a Krüppel-Associated Box (KRAB) domain or a homologue thereof.

In some embodiments, a polynucleotide is less than or equal to about 6 kilobases (kb) in length, for example, less than or equal to about: 6.1, 6.0, 5.9, 5.8, 5.7, 5.6, 5.5, 5.4, 5.3, 5.2, 5.1, 5.0, 4.9, 4.8, 4.7, 4.6, 4.5, 4.4, 4.3, 4.2, 4.1, 4.0, 3.9, 3.8, 3.7, 3.6, 3.5, 3.4, 3.3, 3.2, 3.1, 3.0, 2.9, 2.8, 2.7, 2.6, 2.5, 2.4, 2.3, 2.2, 2.1, 2.0, 1.9, 1.8 or 1.7 kb in length. In some embodiments, a polynucleotide is less than or equal to about 4.7 kb in length. In some embodiments, a polynucleotide is about: 1.7-6.2 kb in length, for example, about: 1.8-6.2 kb, 1.8-6.1 kb, 2.0-6.1 kb, 2.0-6.0 kb, 2.2-6.0 kb, 2.2-5.9 kb, 2.4-5.9 kb, 2.4-5.8 kb, 2.6-5.8 kb, 2.6-5.7 kb, 2.8-5.7 kb, 2.8-5.6 kb, 3.0-5.6 kb, 3.0-5.5 kb, 3.2-5.5 kb, 3.2-5.4 kb, 3.4-5.4 kb, 3.4-5.3 kb, 3.6-5.3 kb, 3.6-5.2 kb, 3.8-5.2 kb, 3.8-5.1 kb, 4.0-5.1 kb, 4.0-5.0 kb, 4.2-5.0 kb, 4.2-4.9 kb, 4.4-4.9 kb, 4.4-4.8 kb, 4.6-4.8 kb, or 4.6-4.7 kb.

In some embodiments, a polynucleotide is single stranded (ss).

In some embodiments, a polynucleotide is double stranded (ds).

In some embodiments, a polynucleotide described herein is a DNA molecule (e.g., a linear or a circular DNA molecule).

In some embodiments, a polynucleotide described herein is an RNA molecule (e.g., a linear or a circular RNA molecule).

In some embodiments, a polynucleotide comprises:
a) a nucleotide sequence encoding a H3K4me0 having at least about 80% sequence identity to at least one sequence set forth in SEQ ID NOs:84 and 88;
b) a nucleotide sequence encoding a Dnmt3L C-terminal domain having at least about 80% sequence identity to at least one sequence set forth in SEQ ID NOs:51-70 and 76-80; or
c) a nucleotide sequence encoding a dCas9 having at least about 80% sequence identity to the nucleotide sequence set forth in SEQ ID NO:2,
or any combination of the foregoing.

In some embodiments, a polynucleotide comprises:
a) a nucleotide sequence encoding a H3K4me0 having 100% sequence identity to a sequence set forth in SEQ ID NOs:84 and 88;
b) a nucleotide sequence encoding a Dnmt3L C-terminal domain having 100% sequence identity to a sequence set forth in SEQ ID NOs:51-70 and 76-80; or
c) a nucleotide sequence encoding a dCas9 having 100% sequence identity to the nucleotide sequence set forth in SEQ ID NO:2,
or any combination of the foregoing.

In some embodiments, a polynucleotide comprises:
a) a nucleotide sequence encoding a H3K4me0 having 100% sequence identity to the sequence set forth in SEQ ID NO:84;

b) a nucleotide sequence encoding a Dnmt3L C-terminal domain having 100% sequence identity to the sequence set forth in SEQ ID NO:51, SEQ ID NO:52, or SEQ ID NO:58; or
c) a dCas9 having 100% sequence identity to the nucleotide sequence set forth in SEQ ID NO:2,
or any combination of the foregoing.

In some embodiments, a polynucleotide comprises a nucleotide sequence having at least about 80% sequence identity to at least one sequence set forth in SEQ ID NOs:170-182, 399 and 400, for example, has at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to at least one sequence set forth in SEQ ID NOs:170-182, 399 and 400. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to at least one sequence set forth in SEQ ID NOs:170-182, 399 and 400. In some embodiments, a polynucleotide comprises a nucleotide sequence having 100% sequence identity to a sequence set forth in SEQ ID NOs:170-182, 399 and 400.

In some embodiments, a polynucleotide comprises a nucleotide sequence having at least about 80% sequence identity to at least one sequence set forth in SEQ ID NOs:170-175, 399 and 400, for example, has at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to at least one sequence set forth in SEQ ID NOs:170-175, 399 and 400. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to at least one sequence set forth in SEQ ID NOs:170-175, 399 and 400. In some embodiments, a polynucleotide comprises a nucleotide sequence having 100% sequence identity to a sequence set forth in SEQ ID NOs:170-175, 399 and 400.

In some embodiments, a polynucleotide comprises a nucleotide sequence having at least about 80% sequence identity to at least one sequence set forth in SEQ ID NOs:170, 173, 175, 399 and 400, for example, has at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to at least one sequence set forth in SEQ ID NOs:170, 173, 175, 399 and 400. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to at least one sequence set forth in SEQ ID NOs:170, 173, 175, 399 and 400. In some embodiments, a polynucleotide comprises a nucleotide sequence having 100% sequence identity to a sequence set forth in SEQ ID NOs:170, 173, 175, 399 and 400.

In some embodiments, a polynucleotide comprises a nucleotide sequence having at least about 80% sequence identity to the nucleotide sequence set forth in SEQ ID NO:399, for example, has at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to the sequence set forth in SEQ ID NO:399. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to the sequence set forth in SEQ ID NO:399. In some embodiments, a polynucleotide comprises a nucleotide sequence having 100% sequence identity to the sequence set forth in SEQ ID NO:399.

In some embodiments, a polynucleotide comprises a nucleotide sequence having at least about 80% sequence identity to the nucleotide sequence set forth in SEQ ID NO:400, for example, has at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to the sequence set forth in SEQ ID NO:400. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to the sequence set forth in SEQ ID NO:400. In some embodiments, a polynucleotide comprises a nucleotide sequence having 100% sequence identity to the sequence set forth in SEQ ID NO:400.

In some embodiments, a polynucleotide comprises a nucleotide sequence having at least about 80% sequence identity to at least one sequence set forth in SEQ ID NOs:171, 172 and 174, for example, has at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to at least one sequence set forth in SEQ ID NOs:171, 172 and 174. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to at least one sequence set forth in SEQ ID NOs:171, 172 and 174. In some embodiments, a polynucleotide comprises a nucleotide sequence having 100% sequence identity to a sequence set forth in SEQ ID NOs:171, 172 and 174.

In some embodiments, a polynucleotide comprises a nucleotide sequence having at least about 80% sequence identity to at least one sequence set forth in SEQ ID NOs:176-182, for example, has at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to at least one sequence set forth in SEQ ID NOs:176-182. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to at least one sequence set forth in SEQ ID NOs:176-182. In some embodiments, a polynucleotide comprises a nucleotide sequence having 100% sequence identity to a sequence set forth in SEQ ID NOs:176-182.

In some embodiments, a polynucleotide comprises a nucleotide sequence having at least about 80% sequence identity to at least one sequence set forth in SEQ ID NOs:177-182, for example, has at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to at least one sequence set forth in SEQ ID NOs:177-182. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to at least one sequence set forth in SEQ ID NOs:177-182. In some embodiments, a polynucleotide comprises a nucleotide sequence having 100% sequence identity to a sequence set forth in SEQ ID NOs:177-182.

In some embodiments, a polynucleotide comprises a nucleotide sequence having at least about 80% sequence identity to the amino acid sequence set forth in SEQ ID NO:176, for example, has at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to the sequence set forth in SEQ ID NO:176. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to the sequence set forth in SEQ ID NO:176. In some embodiments, a polynucleotide comprises a nucleotide sequence having 100% sequence identity to the sequence set forth in SEQ ID NO:176.

In some embodiments, a polynucleotide further comprises a nucleotide sequence encoding a tag and/or a reporter, for example, a blue fluorescent protein (e.g., SEQ ID NO:154).

In some embodiments, a polynucleotide lacks a nucleotide sequence encoding a DNA methyltransferase catalytic domain, or a Krüppel-associated box domain (e.g., SEQ ID NO:156), or both. In some embodiments, a polynucleotide lacks a nucleotide sequence encoding a DNA methyltransferase catalytic domain, for example, a catalytic domain of DNMT3A, DNMT3B, or DNMT3C. In some embodiments, a polynucleotide lacks a nucleotide sequence encoding a catalytic domain of DNMT3A. In some embodiments, a polynucleotide lacks a nucleotide sequence encoding a Krüppel-associated box domain. In some embodiments, a polynucleotide lacks a nucleotide sequence encoding a DNA methyltransferase catalytic domain, and a Krüppel-associated box domain.

In some embodiments, a fusion protein disclosed herein is encoded by a single polynucleotide. In some embodiments, a fusion protein disclosed herein is encoded by two or more polynucleotides.

In some embodiments, a polynucleotide disclosed herein comprises a nucleotide sequence that is codon-optimized, for example, for a chosen cell. In some embodiments, codons in a polynucleotide are optimized based on the relative abundance of corresponding tRNAs in a chosen cell, for example, to modulate (e.g., to increase or to decrease) expression. Codon optimization is known to those of ordinary skill the art, see, e.g., Patent Cooperation Treaty (PCT) Application Publication Nos. WO1999041397 and WO2001079518, the entire contents of which are incorporated herein by reference.

A polynucleotide may be produced by any means available to those of skill in the art. In some embodiments, a polynucleotide is cloned by a standard technique. In some embodiments, a polynucleotide (e.g., a DNA polynucleotide) is produced recombinantly. In some embodiments, a polynucleotide is produced using a polymerase chain reaction (PCR) cloning technique. In some embodiments, a polynucleotide is produced synthetically.

In some embodiments, a polynucleotide is extrachromosomal in a cell. In some embodiments, a polynucleotide is integrated into a cell's genome.

Polynucleotides Encoding DNA-Binding Domains

In some embodiments, a polynucleotide comprises a sequence encoding a CRISPR-associated protein (e.g., dCas9). In some embodiments, a polynucleotide further comprises a nucleotide sequence encoding a sgRNA. In some embodiments, a polynucleotide further comprises a promoter (e.g., a U6 promoter) to drive sgRNA expression.

In some embodiments, a nucleotide sequence encoding a DNA-binding domain has at least about 80% sequence identity to SEQ ID NO:2, for example, having at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to SEQ ID NO:2. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to SEQ ID NO:2. In some embodiments, a nucleotide sequence encoding a DNA-binding domain has 100% sequence identity to SEQ ID NO:2.

In some embodiments, a nucleotide sequence encoding a DNA-binding domain has at least about 80% sequence identity to SEQ ID NO:442, for example, having at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to SEQ ID NO:442. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to SEQ ID NO:442. In some embodiments, a nucleotide sequence encoding a DNA-binding domain has 100% sequence identity to SEQ ID NO:442.

In some embodiments, a nucleotide sequence encoding a DNA-binding domain has at least about 80% sequence identity to at least one sequence set forth in SEQ ID NOs:16-28, for example, has at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to at least one sequence set forth in SEQ ID NOs:16-28. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to at least one sequence set forth in SEQ ID NOs:16-28. In some embodiments, a nucleotide sequence encoding a DNA-binding domain has 100% sequence identity to a sequence set forth in SEQ ID NOs:16-28.

In some embodiments, a nucleotide sequence encoding a DNA-binding domain has at least about 80% sequence identity to at least one sequence set forth in SEQ ID NOs:2 and 16-28, for example, has at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to at least one sequence set forth in SEQ ID NOs:2 and 16-28. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to at least one sequence set forth in SEQ ID NOs:2 and 16-28. In some embodiments, a nucleotide sequence encoding a DNA-binding domain has 100% sequence identity to a sequence set forth in SEQ ID NOs:2 and 16-28.

In some embodiments, a nucleotide sequence encoding a DNA-binding domain has at least about 80% sequence identity to at least one sequence set forth in SEQ ID NOs:2, 16-28, and 438-453, for example, has at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to at least one sequence set forth in SEQ ID NOs:2, 16-28, and 438-453. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to at least one sequence set forth in SEQ ID NOs:2, 16-28, and 438-453. In some embodiments, a nucleotide sequence encoding a DNA-binding domain has 100% sequence identity to a sequence set forth in SEQ ID NOs:2, 16-28, and 438-453.

Polynucleotides Encoding DNMT3 Methyltransferase-Binding Domains

In some embodiments, a nucleotide sequence encoding a DNMT3 methyltransferase-binding domain has at least about 80% sequence identity to SEQ ID NOs:51-70 and 76-80, for example, having at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to SEQ ID NOs:51-70 and 76-80. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to SEQ ID NOs:51-70 and 76-80. In some embodiments, a nucleotide sequence encoding a DNMT3 methyltransferase-binding domain has 100% sequence identity to SEQ ID NOs:51-70 and 76-80.

In some embodiments, a polynucleotide comprises a nucleotide sequence encoding a Dnmt3L C-terminal domain.

In some embodiments, a nucleotide sequence encoding a Dnmt3L C-terminal domain has at least about 80% sequence identity to at least one sequence set forth in SEQ ID NOs:51-70, for example, having at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to at least one sequence set forth in SEQ ID NOs:51-70. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to at least one sequence set forth in SEQ ID NOs:51-70. In some embodiments, nucleotide sequence encoding a Dnmt3L C-terminal domain has 100% sequence identity to a sequence set forth in SEQ ID NOs:51-70.

In some embodiments, a nucleotide sequence encoding a Dnmt3L C-terminal domain has at least about 80% sequence identity to the sequence set forth in SEQ ID NO:51, for example, having at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to the sequence set forth in SEQ ID NO:51. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to the sequence set forth in SEQ ID NO:51. In some embodiments, a nucleotide sequence encoding a Dnmt3L C-terminal domain has 100% sequence identity to the sequence set forth in SEQ ID NO:51.

In some embodiments, a nucleotide sequence encoding a Dnmt3L C-terminal domain has at least about 80% sequence identity to the sequence set forth in SEQ ID NO:52, for example, having at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to the sequence set forth in SEQ ID NO:52. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to the sequence set forth in SEQ ID NO:52. In some embodiments, a nucleotide sequence encoding a Dnmt3L C-terminal domain has 100% sequence identity to the sequence set forth in SEQ ID NO:52.

In some embodiments, a nucleotide sequence encoding a Dnmt3L C-terminal domain has at least about 80% sequence identity to the sequence set forth in SEQ ID NO:58, for example, having at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to the sequence set forth in SEQ ID NO:58. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to the sequence set forth in SEQ ID NO:58. In some embodiments, a nucleotide sequence encoding a Dnmt3L C-terminal domain has 100% sequence identity to the sequence set forth in SEQ ID NO:58.

In some embodiments, a nucleotide sequence encoding a Dnmt3L C-terminal domain has at least about 80% sequence identity to at least one sequence set forth in SEQ ID NOs:76-80, for example, having at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to at least one sequence set forth in SEQ ID NOs:76-80. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to at least one sequence set forth in SEQ ID NOs:76-80. In some embodiments, a nucleotide sequence encoding a Dnmt3L C-terminal domain has 100% sequence identity to a sequence set forth in SEQ ID NOs:76-80.

Polynucleotides Encoding H3K4me0

In some embodiments, a nucleotide sequence encoding a H3K4me0 has at least about 80% sequence identity to the sequence set forth in SEQ ID NO:84, for example, having at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to the sequence set forth in SEQ ID NO:84. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to the sequence set forth in SEQ ID NO:84. In some embodiments, a nucleotide sequence encoding a H3K4me0 has 100% sequence identity to the sequence set forth in SEQ ID NO:84.

In some embodiments, a nucleotide sequence encoding a H3K4me0 is about 90 nucleotides in length.

In some embodiments, a nucleotide sequence encoding a H3K4me0 has at least about 80% sequence identity to the sequence set forth in SEQ ID NO:88, for example, having at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to the sequence set forth in SEQ ID NO:88. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to the sequence set forth in SEQ ID NO:88. In some embodiments, a nucleotide sequence encoding a H3K4me0 has 100% sequence identity to the sequence set forth in SEQ ID NO:88.

In some embodiments, a nucleotide sequence encoding a H3K4me0 has at least about 80% sequence identity to at least one sequence set forth in SEQ ID NOs:84 and 88, for example, has at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to at least one sequence set forth in SEQ ID NOs:84 and 88. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to at least one sequence set forth in SEQ ID NOs:84 and 88. In some embodiments, a nucleotide sequence encoding a H3K4me0 has 100% sequence identity to a sequence set forth in SEQ ID NOs:84 and 88.

Polynucleotides Encoding Linkers

In some embodiments, a polynucleotide disclosed herein further comprises a nucleotide sequence encoding a linker.

In some embodiments, a nucleotide sequence encoding a linker has at least about 80% sequence identity to the sequence set forth in SEQ ID NO:101, for example, having at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to the sequence set forth in SEQ ID NO:101. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to the sequence set forth in SEQ ID NO:101. In some embodiments, a nucleotide sequence encoding a linker has 100% sequence identity to the sequence set forth in SEQ ID NO:101.

In some embodiments, a nucleotide sequence encoding a linker has at least about 80% sequence identity to at least one sequence set forth in SEQ ID NOs:101-102, for example, has at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to at least one sequence set forth in SEQ ID NOs:101-102. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to at least one sequence set forth in SEQ ID NOs:101-102. In some embodiments, a nucleotide sequence encoding a linker has 100% sequence identity to a sequence set forth in SEQ ID NOs: 101-102.

In some embodiments, a nucleotide sequence encoding a linker has at least about 80% sequence identity to the sequence set forth in SEQ ID NO:102, for example, having at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to the sequence set forth in SEQ ID NO:102. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to the sequence set forth in SEQ ID NO:102. In some embodiments, a nucleotide sequence encoding a linker has 100% sequence identity to the sequence set forth in SEQ ID NO:102.

In some embodiments, a nucleotide sequence encoding a linker has at least about 80% sequence identity to at least one sequence set forth in SEQ ID NOs:103-112, for example, has at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to at least one sequence set forth in SEQ ID NOs:103-112. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to at least one sequence set forth in SEQ ID NOs:103-112. In some embodiments, a nucleotide sequence encoding a linker has 100% sequence identity to a sequence set forth in SEQ ID NOs:103-112.

In some embodiments, a polynucleotide comprises a nucleotide sequence encoding a XTEN linker, for example, a XTEN16, XTEN24, XTEN32, XTEN34, XTEN36, XTEN38, XTEN40, XTEN42, XTEN44, XTEN46, XTEN48, XTEN50, XTEN52, XTEN54, or XTEN80 linker.

In some embodiments, a nucleotide sequence encoding a linker has at least about 80% sequence identity to at least one sequence set forth in SEQ ID NOs:129-144 (e.g., SEQ ID NOs:129-143), for example, has at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to at least one sequence set forth in SEQ ID NOs:129-144 (e.g., SEQ ID NOs:129-143). In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to at least one sequence set forth in SEQ ID NOs:129-144 (e.g., SEQ ID NOs:129-143). In some embodiments, a nucleotide sequence encoding a linker has 100% sequence identity to a sequence set forth in SEQ ID NOs:129-144 (e.g., SEQ ID NOs:129-143).

In some embodiments, a nucleotide sequence encoding a linker has at least about 80% sequence identity to the sequence set forth in SEQ ID NO:144, for example, having at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to the sequence set forth in SEQ ID NO:144. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to the sequence set forth in SEQ ID NO:144. In some embodiments, a nucleotide sequence encoding a linker has 100% sequence identity to the sequence set forth in SEQ ID NO:144.

In some embodiments, a polynucleotide comprises a nucleotide sequence encoding a self-cleaving linker.

In some embodiments, a polynucleotide comprises a nucleotide sequence encoding a P2A self-cleaving linker. In some embodiments, a nucleotide sequence encoding a P2A self-cleaving linker has at least about 80% sequence identity to the nucleotide sequence set forth in SEQ ID NO:146, for example, has at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to the sequence set forth in SEQ ID NO:146. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to the sequence set forth in SEQ ID NO:146. In some embodiments, a nucleotide sequence encoding a P2A self-cleaving linker has 100% sequence identity to the sequence set forth in SEQ ID NO:146.

In some embodiments, a polynucleotide comprises a nucleotide sequence encoding a T2A self-cleaving linker. In some embodiments, a nucleotide sequence encoding a T2A self-cleaving linker has at least about 80% sequence identity to the nucleotide sequence set forth in SEQ ID NO:148, for example, has at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to the sequence set forth in SEQ ID NO:148. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to the sequence set forth in SEQ ID NO:148. In some embodiments, a nucleotide sequence encoding a T2A self-cleaving linker has 100% sequence identity to the sequence set forth in SEQ ID NO:148.

In some embodiments, a nucleotide sequence encoding a linker has at least about 80% sequence identity to at least one sequence set forth in SEQ ID NOs:101-112, SEQ ID NOs:129-144, SEQ ID NO:146 and SEQ ID NO:148, for example, has at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to at least one sequence set forth in SEQ ID NOs:101-112, SEQ ID NOs:129-144, SEQ ID NO:146 and SEQ ID NO:148. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to at least one sequence set forth in SEQ ID NOs:101-112, SEQ ID NOs:129-144, SEQ ID NO:146 and SEQ ID NO:148. In some embodiments, a nucleotide sequence encoding a linker has 100% sequence identity to a sequence set forth in SEQ ID NOs:101-112, SEQ ID NOs:129-144, SEQ ID NO:146 and SEQ ID NO:148.

In some embodiments, a nucleotide sequence encoding a linker has at least about 80% sequence identity to at least one sequence set forth in SEQ ID NOs:108, 112, and 135, for example, has at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to at least one sequence set forth in SEQ ID NOs:108, 112, and 135. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to at least one sequence set forth in SEQ ID NOs:108, 112, and 135. In some embodiments, a nucleotide sequence encoding a linker has 100% sequence identity to a sequence set forth in SEQ ID NOs:108, 112, and 135.

Polynucleotides Encoding Domains that Recruit Histone Methyltransferases

In some embodiments, a polynucleotide comprises a nucleotide sequence encoding a domain that recruits a histone methyltransferase. In some embodiments, a domain that recruits a histone methyltransferase comprises a Krüppel-associated box (KRAB) domain or a homologue thereof. In some embodiments, a nucleotide sequence encoding a KRAB domain has at least about 80% sequence identity to the nucleotide sequence set forth in SEQ ID NO:156, for example, has at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to the sequence set forth in SEQ ID NO:156. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to the sequence set forth in SEQ ID NO:156. In some embodiments, a nucleotide sequence encoding a KRAB domain has 100% sequence identity to the sequence set forth in SEQ ID NO:156.

In some embodiments, a KRAB domain is a KOX1 KRAB domain.

Polynucleotides Encoding Histone Methyltransferases

In some embodiments, a polynucleotide comprises a nucleotide sequence encoding a histone methyltransferase or a homologue thereof. In some embodiments, a polynucleotide comprises a nucleotide sequence encoding an EZH2 protein or a fragment thereof (e.g., having histone methyltransferase catalytic activity).

Polynucleotides Encoding Nuclear Localization Signal (NLS)

In some embodiments, a polynucleotide comprises a nucleotide sequence encoding an NLS.

In some embodiments, a polynucleotide comprises a nucleotide sequence encoding a bipartite NLS. In some embodiments, a nucleotide sequence encoding a bipartite NLS has at least about 80% sequence identity to the nucleotide sequence set forth in SEQ ID NO:150, for example, has at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to the sequence set forth in SEQ ID NO:150. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to the sequence set forth in SEQ ID NO:150. In some embodiments, a nucleotide sequence encoding a bipartite NLS has 100% sequence identity to the sequence set forth in SEQ ID NO:150.

In some embodiments, a polynucleotide comprises a nucleotide sequence encoding a SV40 NLS. In some embodiments, a nucleotide sequence encoding a SV40 NLS has at least about 80% sequence identity to the nucleotide sequence set forth in SEQ ID NO:152, for example, has at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to the sequence set forth in SEQ ID NO:152. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to the sequence set forth in SEQ ID NO:152. In some embodiments, a nucleotide sequence encoding a SV40 NLS has 100% sequence identity to the sequence set forth in SEQ ID NO:152.

In some embodiments, a nucleotide sequence encoding a NLS has at least about 80% sequence identity to the nucleotide sequence set forth in SEQ ID NO:150 or SEQ ID NO:152, for example, has at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to the sequence set forth in SEQ ID NO:150 or SEQ ID NO:152. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to the sequence set forth in SEQ ID NO:150 or SEQ ID NO:152. In some embodiments, a nucleotide sequence encoding a NLS has 100% sequence identity to the sequence set forth in SEQ ID NO:150 or SEQ ID NO:152.

Multiplexing

Also provided herein, among other things, is a polynucleotide encoding two or more fusion proteins disclosed herein. In some embodiments, a polynucleotide comprises nucleotide sequences encoding, e.g., from 5' to 3', H3K4me0 (e.g., SEQ ID NO:87), a KRAB domain, a DNMT3 methyltransferase-binding domain (e.g., DNMT3L *Apodemus sylvaticus*), a N-intein (e.g., NpuN intein), a first ribosomal skipping sequence, a first C-intein (e.g., NpuC intein), a first DNA binding domain, a second ribosomal skipping sequence, a second C-intein (e.g., NpuC intein), and a second DNA-binding domain. In some embodiments, a polynucleotide comprises nucleotide sequences encoding, e.g., from 5' to 3', H3K4me0 (e.g., SEQ ID NO:87), a KRAB domain, a DNMT3 methyltransferase-binding domain (e.g., DNMT3L *Apodemus sylvaticus*), a N-intein (e.g., NpuN intein), a first ribosomal skipping sequence, a first C-intein (e.g., NpuC intein), a first DNA-binding domain, a second ribosomal skipping sequence, a second C-intein (e.g., NpuC intein), a second DNA-binding domain, a third ribosomal skipping sequence, a third C-intein (e.g., NpuC intein), and a third DNA-binding domain.

H3K4me0 can be any one of the H3K4me0 described herein. In some embodiments, H3K4me0 is greater than or equal to 12 amino acids in length. In some embodiments, H3K4me0 is less than or equal to 57 amino acids in length. In some embodiments, H3K4me0 is about 12 to 57 amino acids in length, for example, about: 12-55, 12-50, 15-50, 15-45, 20-45, 20-40, 21-39, 22-38, 23-37, 24-36, 25-35, 26-34, 27-33, 28-32, or 29-31 amino acids in length. In some embodiments, H3K4me0 is about 28 to 32 amino acids in length. In some embodiments, a H3K4me0 is about 30 amino acids in length.

In some embodiments, a H3K4me0 comprises an amino acid having at least about 80% sequence identity to the sequence set forth in SEQ ID NO:87, for example, has at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to the sequence set forth in SEQ ID NO:87. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to the sequence set forth in SEQ ID NO:87. In some embodiments, a H3K4me0 comprises an amino acid having 100% sequence identity to the sequence set forth in SEQ ID NO:87.

A Dnmt3L C-terminal domain can be any one of the Dnmt3L C-terminal domains described herein. In some embodiments, a Dnmt3L C-terminal domain is that of *Apodemus sylvaticus*. In some embodiments, a Dnmt3L C-terminal domain comprises an amino acid sequence having at least about 80% sequence identity to the sequence set forth in SEQ ID NO:32, for example, having at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to the sequence set forth in SEQ ID NO:32. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to the sequence set forth in SEQ ID NO:32. In some embodiments, a Dnmt3L C-terminal domain comprises an amino acid sequence having 100% sequence identity to the sequence set forth in SEQ ID NO:32.

In some embodiments, a first ribosomal skipping sequence comprises at least one P2A self-cleaving linker sequence (e.g., SEQ ID NO:145). In some embodiments, a first ribosomal skipping sequence comprises at least one T2A self-cleaving linker sequence (e.g., SEQ ID NO:147). In some embodiments, a first ribosomal skipping sequence comprises at least one P2A self-cleaving linker sequence (e.g., SEQ ID NO:145) and at least one T2A self-cleaving linker sequence (e.g., SEQ ID NO:147).

In some embodiments, a second ribosomal skipping sequence comprises at least one P2A self-cleaving linker sequence (e.g., SEQ ID NO:145). In some embodiments, a second ribosomal skipping sequence comprises at least one T2A self-cleaving linker sequence (e.g., SEQ ID NO:147). In some embodiments, a second ribosomal skipping sequence comprises at least one P2A self-cleaving linker sequence (e.g., SEQ ID NO:145) and at least one T2A self-cleaving linker sequence (e.g., SEQ ID NO:147).

In some embodiments, a third ribosomal skipping sequence comprises at least one P2A self-cleaving linker sequence (e.g., SEQ ID NO:145). In some embodiments, a third ribosomal skipping sequence comprises at least one T2A self-cleaving linker sequence (e.g., SEQ ID NO:147). In some embodiments, a third ribosomal skipping sequence comprises at least one P2A self-cleaving linker sequence (e.g., SEQ ID NO:145) and at least one T2A self-cleaving linker sequence (e.g., SEQ ID NO:147).

In some embodiments, a first ribosomal skipping sequence and/or a second ribosomal skipping sequence comprise a core sequence motif of DxExNPGP, where x is any amino acid. In some embodiments, a first ribosomal skipping sequence and/or a second ribosomal skipping sequence comprise a E2A sequence (e.g., SEQ ID NO:435). In some embodiments, a first ribosomal skipping sequence and/or a second ribosomal skipping sequence comprise a F2A sequence (e.g., SEQ ID NO:436).

In some embodiments, a first ribosomal skipping sequence, a second ribosomal skipping sequence, and/or a third ribosomal skipping sequence comprise a core sequence motif of DxExNPGP (SEQ ID NO:437), where x is any amino acid. In some embodiments, a first ribosomal skipping sequence, a second ribosomal skipping sequence, and/or a third ribosomal skipping sequence comprise a E2A sequence (e.g., SEQ ID NO:435). In some embodiments, a first ribosomal skipping sequence, a second ribosomal skipping sequence, and/or a third ribosomal skipping sequence comprise a F2A sequence (e.g., SEQ ID NO:436).

In some embodiments, a N-intein and a first C-intein form a peptide bond in a cell. In some embodiments, a N-intein and a second C-intein form a peptide bond in a cell. In some embodiments, a N-intein and a third C-intein form a peptide bond in a cell. In some embodiments, a N-intein, a first C-intein and a second C-intein are naturally split DnaE inteins. In some embodiments, a N-intein, a first C-intein, a second C-intein and a third C-intein are naturally split DnaE inteins. Non-limiting examples of naturally split DnaE inteins include those of Npu, Ssp (PCC6803), Aha, Aov, Asp, Ava, Cra (CS505), Csp (CCY0110), Csp (PCC7424), Csp (PCC8801), Cwa, Maer (NIES843), Mcht (PCC7420), Oli, Sel (PC7942), Ssp (PCC7002), Tel, Ter, and Tvu. See, e.g., Shah & Muir, *Split Inteins: Nature's Protein Ligases*, Isr J Chem. 51(8-9):854-61 (2011), the entire contents of which are incorporated herein by reference. In some embodiments, a N-intein comprises N-NpuDnaE (e.g., SEQ ID NO:417), or a variant thereof, and a first C-intein and a second C-intein each comprises C-NpuDnaE (e.g., SEQ ID NO:419), or a variant thereof. In some embodiments, a N-intein comprises N-NpuDnaE (e.g., SEQ ID NO:417), or a variant thereof, and a first C-intein, a second C-intein and a third C-intein each comprises C-NpuDnaE (e.g., SEQ ID NO:419), or a variant thereof.

In some embodiments, a fusion protein promoter flanking sequence (e.g., upstream and/or downstream of the promoter) comprises a nucleotide sequence recognized by a first DNA-binding domain. In some embodiments, a first DNA-binding domain recognition sequence is not recognized by a second DNA-binding domain.

In some embodiments, a fusion protein promoter flanking sequence (e.g., upstream and/or downstream of the promoter) comprises a nucleotide sequence recognized by a second DNA-binding domain. In some embodiments, a second DNA-binding domain recognition sequence is not recognized by a first DNA-binding domain.

In some embodiments, a first DNA-binding domain and a second DNA-binding domain are of the same type. In some embodiments, a first DNA-binding domain comprises a DNA-binding domain of a ZFN, and a second DNA-binding domain comprises a DNA-binding domain of a ZFN.

In some embodiments, a first DNA-binding domain and a second DNA-binding domain are of different types. In some embodiments, a first DNA-binding domain comprises a DNA-binding domain of a ZFN, and a second DNA-binding domain comprises a DNA-binding domain of a transcription activator-like effector nuclease (TALEN). In some embodiments, a first DNA-binding domain comprises a DNA-binding domain of a TALEN, and a second DNA-binding domain comprises a DNA-binding domain of a ZFN.

In some embodiments, a first DNA-binding domain, a second DNA-binding domain, and a third DNA-binding domain are of the same type. In some embodiments, a first DNA-binding domain comprises a DNA-binding domain of a ZFN, a second DNA-binding domain comprises a DNA-binding domain of a ZFN, and a third DNA-binding domain comprises a DNA-binding domain of a ZFN.

In some embodiments, a first DNA-binding domain has a nuclear localization signal (NLS) appended to its N-terminus, its C-terminus, or both. In some embodiments, a first DNA-binding domain has a NLS appended to its N-terminus. In some embodiments, a first DNA-binding domain has a NLS appended to its C-terminus. In some embodiments, a first DNA-binding domain has a NLS appended to both its N-terminus and its C-terminus. In some embodiments, a NLS is a bipartite NLS.

In some embodiments, a second DNA-binding domain has a NLS appended to its N-terminus, its C-terminus, or both. In some embodiments, a second DNA-binding domain has a NLS appended to its N-terminus. In some embodiments, a second DNA-binding domain has a NLS appended to its C-terminus. In some embodiments, a second DNA-binding domain has a NLS appended to both its N-terminus and its C-terminus. In some embodiments, a NLS is a bipartite NLS.

In some embodiments, a third DNA-binding domain has a NLS appended to its N-terminus, its C-terminus, or both. In some embodiments, a third DNA-binding domain has a NLS appended to its N-terminus. In some embodiments, a third DNA-binding domain has a NLS appended to its C-terminus. In some embodiments, a third DNA-binding domain has a NLS appended to both its N-terminus and its C-terminus. In some embodiments, a NLS is a bipartite NLS.

In some embodiments, a polynucleotide further comprises a nucleotide sequence encoding a switchable nuclear-localization sequence. In some embodiments, a switchable nuclear-localization sequence enables nuclear localization and/or nuclear accumulation of a first DNA-binding domain. In some embodiments, a switchable nuclear-localization sequence enables nuclear localization and/or nuclear accumulation of a second DNA-binding domain. In some embodiments, a switchable nuclear-localization sequence enables nuclear localization and/or nuclear accumulation of a third DNA-binding domain. In some embodiments, a switchable nuclear-localization sequence allows precise, user-defined control, e.g., temporal control, of nuclear-localization. For additional information on switchable nuclear-localization, see, e.g., Niopek et al., Engineering light-inducible nuclear localization signals for precise spatiotemporal control of protein dynamics in living cells, Nat Commun. 5:4404 (2014), Di Ventura & Kuhlman, Go in! Go out! Inducible control of nuclear localization, Curr Opin Chem Biol. 34:62-71 (2016), and Shin et al., Cytosolic microRNA-inducible nuclear translocation of Cas9 protein for disease-specific genome modification, Nucleic Acids Res. 50(10):5919-33 (2022), the entire contents of which are incorporated herein by reference. In some embodiments, a switchable nuclear-localization sequence comprises a sequence encoding a sensitized variant of the human estrogen receptor, ERT2, which can be activated by tamoxifen metabolite trans-4-OH-Tamoxifen (trans-4-OHT). See, e.g., Li et al., Multidimensional control of therapeutic human cell function with synthetic gene circuits, Science 378(6625): 1227-34 (2022), the entire contents of which are incorporated herein by reference.

Vectors

Also provided herein, among other things, is a vector (e.g., an expression vector, including a viral-delivery vector) comprising any one or more of the polynucleotides disclosed herein.

In some embodiments, a vector is less than or equal to about 6.2 kilobases (kb) in length, for example, less than or equal to about: 6.1, 6.0, 5.9, 5.8, 5.7, 5.6, 5.5, 5.4, 5.3, 5.2, 5.1, 5.0, 4.9, 4.8, 4.7, 4.6, 4.5, 4.4, 4.3, 4.2, 4.1, 4.0, 3.9, 3.8, 3.7, 3.6, 3.5, 3.4, 3.3, 3.2, 3.1, 3.0, 2.9, 2.8, 2.7, 2.6, 2.5, 2.4, 2.3, 2.2, 2.1, 2.0, 1.9, 1.8 or 1.7 kb in length. In some embodiments, a vector is less than or equal to about 4.7 kb in length. In some embodiments, a vector is about: 1.7-6.2 kb in length, for example, about: 1.8-6.2 kb, 1.8-6.1 kb, 2.0-6.1 kb, 2.0-6.0 kb, 2.2-6.0 kb, 2.2-5.9 kb, 2.4-5.9 kb, 2.4-5.8 kb, 2.6-5.8 kb, 2.6-5.7 kb, 2.8-5.7 kb, 2.8-5.6 kb, 3.0-5.6 kb, 3.0-5.5 kb, 3.2-5.5 kb, 3.2-5.4 kb, 3.4-5.4 kb, 3.4-5.3 kb, 3.6-5.3 kb, 3.6-5.2 kb, 3.8-5.2 kb, 3.8-5.1 kb, 4.0-5.1 kb, 4.0-5.0 kb, 4.2-5.0 kb, 4.2-4.9 kb, 4.4-4.9 kb, 4.4-4.8 kb, 4.6-4.8 kb, or 4.6-4.7 kb.

In some embodiments, a vector disclosed herein (e.g., expression vector) comprises an expression control polynucleotide sequence operably linked to the polynucleotide, a polynucleotide sequence encoding a selectable marker, or both. In some embodiments, a vector comprises an expression control polynucleotide sequence, for example, a promoter, a translation initiation sequence, a post-transcriptional regulatory element, a poly(A) signal, or any combination thereof.

In some embodiments, a vector comprises a human synapsin promoter.

In some embodiments, a vector comprises an SV40 promoter.

In some embodiments, a vector comprises a CAG promoter. In some embodiments, a CAG promoter has at least about 80% sequence identity to the nucleotide sequence set forth in SEQ ID NO:183, for example, has at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to the sequence set forth in SEQ ID NO:183. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to the sequence set forth in SEQ ID NO:183. In some embodiments, a CAG promoter has 100% sequence identity to the sequence set forth in SEQ ID NO:183.

In some embodiments, a vector comprises an EFS promoter. In some embodiments, an EFS promoter has at least about 80% sequence identity to the nucleotide sequence set forth in SEQ ID NO:184, for example, has at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to the sequence set forth in SEQ ID NO:184. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to the sequence set forth in SEQ ID NO:184. In some embodiments, an EFS promoter has 100% sequence identity to the sequence set forth in SEQ ID NO:184.

In some embodiments, a vector comprises a Kozak sequence. In some embodiments, a Kozak sequence has at least about 80% sequence identity to the nucleotide sequence set forth in SEQ ID NO:185, for example, has at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to the sequence set forth in SEQ ID NO:185. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to the sequence set forth in SEQ ID NO:185. In some embodiments, a Kozak sequence has 100% sequence identity to the sequence set forth in SEQ ID NO:185.

In some embodiments, a vector comprises a Woodchuck hepatitis virus post-transcriptional regulatory element (WPRE). In some embodiments, a Woodchuck hepatitis virus post-transcriptional regulatory element has at least about 80% sequence identity to the nucleotide sequence set forth in SEQ ID NO:186, for example, has at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to the sequence set forth in SEQ ID NO:186. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to the sequence set forth in SEQ ID NO:186. In some embodiments, a Woodchuck hepatitis virus post-transcriptional regulatory element has 100% sequence identity to the sequence set forth in SEQ ID NO:186.

In some embodiments, a vector comprises a poly(A) signal.

In some embodiments, a poly(A) signal has at least about 80% sequence identity to the nucleotide sequence set forth in SEQ ID NO:187 or SEQ ID NO:392, for example, has at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to the sequence set forth in SEQ ID NO:187 or SEQ ID NO:392. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to the sequence set forth in SEQ ID NO:187 or SEQ ID NO:392. In some embodiments, a poly(A) signal has 100% sequence identity to the sequence set forth in SEQ ID NO:187 or SEQ ID NO:392.

In some embodiments, a poly(A) signal has at least about 80% sequence identity to the nucleotide sequence set forth in SEQ ID NO:392, for example, has at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to the sequence set forth in SEQ ID NO:392. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to the sequence set forth in SEQ ID NO:392. In some embodiments, a poly(A) signal has 100% sequence identity to the sequence set forth in SEQ ID NO:392.

In some embodiments, a vector comprises a β-globin poly(A) signal. In some embodiments, a β-globin poly(A) signal has at least about 80% sequence identity to the nucleotide sequence set forth in SEQ ID NO:187, for example, has at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity to the sequence set forth in SEQ ID NO:187. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity to the sequence set forth in SEQ ID NO:187. In some embodiments, a β-globin poly(A) signal has 100% sequence identity to the sequence set forth in SEQ ID NO:187.

Gene Delivery Systems

Also provided herein, among other things, is a gene delivery system comprising any one of the polynucleotides or vectors disclosed herein.

In some embodiments, a gene delivery system further comprising a guide RNA. In some embodiments, a guide RNA comprises a single guide RNA (sgRNA). In some embodiments, a guide RNA comprises a CRISPR RNA (crRNA) and a trans-activating CRISPR RNA (tracrRNA) (a cr:tracrRNA). In some embodiments, a fusion protein disclosed herein is delivered together with a sgRNA as a ribonucleoprotein complex.

In some embodiments, a gene delivery system comprises a viral gene-delivery system. In some embodiments, a viral gene-delivery system comprises an adeno-associated viral vector (AAV), an adenoviral vector, a herpes simplex viral vector, or a retroviral vector.

In some embodiments, a gene delivery system comprises an AAV. Any AAV serotype (e.g., human AAV serotype) can be used, for example, AAV serotype 1 (AAV1), AAV serotype 2 (AAV2), AAV serotype 3 (AAV3), AAV serotype 4 (AAV4), AAV serotype 5 (AAV5), AAV serotype 6 (AAV6), AAV serotype 7 (AAV7), AAV serotype 8 (AAV8), AAV serotype 9 (AAV9), AAV serotype 10 (AAV10), AAV serotype 11 (AAV11), AAV serotype 11 (AAV12), a variant thereof, or a shuffled variant thereof (e.g., a chimeric variant thereof). In some embodiments, an AAV vector comprises a AAV3, AAV3b, AAV4, AAV5, AAV6, AAV7, AAV8, AAV9, AAVrh8, or AAV10 viral vector, or a variant thereof.

In some embodiments, an AAV vector comprises a wild-type AAV.

In some embodiments, an AAV vector comprises an AAV variant. In some embodiments, an AAV variant has at least about 80% sequence identity to a wild-type AAV, for example, has at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity sequence identity to a wild-type AAV. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity sequence identity to a wild-type AAV.

In some embodiments, an AAVn variant (n is 1, 2, 3, 4, 5, 6, 7, 8, 9, 10, 11 or 12) has at least about 80% sequence identity to a wild-type AAVn, for example, has at least about: 85%, 88%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, or 99.9% sequence identity sequence identity to a wild-type AAVn. In some embodiments, the sequence has about: 80-99.9%, 80-99.8%, 85-99.8%, 85-99.6%, 88-99.6%, 88-99.5%, 90-99.5%, 90-99.4%, 92-99.4%, 92-99.2%, 95-99.2%, 95-99% or 98-99% sequence identity sequence identity to a wild-type AAVn.

In some embodiments, an AAV vector is an AAV chimera, for example, one or more regions of at least two different AAV serotype viruses are shuffled and reassembled. For example, a chimeric AAV can comprise inverted terminal repeats (ITRs) that are of a heterologous serotype compared to the serotype of the capsid. The resulting chimeric AAV virus can have a different antigenic reactivity or recognition, compared to its parental serotypes. In some embodiments, a chimeric variant of an AAV includes amino acid sequences from 2, 3, 4, 5, or more different AAV serotypes.

AAV vectors are known to those of ordinary skill the art. See, e.g., Weitzman & Linden, Chapter 1-Adeno-Associated Virus Biology in Adeno-Associated Virus: Methods and Protocols Methods in Molecular Biology, vol. 807; Snyder & Moullier, eds., Springer, 2011; Potter et al., Molecular Therapy-Methods & Clinical Development, 2014, 1, 14034; Bartel et al., Gene Therapy, 2012, 19, 694-700; Ward & Walsh, Virology, 2009, 386(2):237-248; and Li et al., Mol Ther, 2008, 16(7):1252-1260, for descriptions of AAV variants and methods for generating thereof, the entire contents of which are incorporated herein by reference.

A fusion protein disclosed herein can be introduced into a target cell by transducing an AAV virion (e.g., a viral vector or viral particle) into the cell. Packaging a polynucleotide or vector disclosed herein into an AAV viral vector can be performed according to any method known to those skilled in the art, for example, as described in McClure et al., J Vis Exp, 2001, 57:3378.

In some embodiments, a gene delivery system comprises a retroviral vector. Retroviruses are a common tool for gene delivery (Miller, 2000, Nature 357: 455-60). Non-limiting examples of retroviruses suitable for use in particular embodiments include Moloney murine leukemia virus (M-MuLV), Moloney murine sarcoma virus (MoMSV), Harvey murine sarcoma virus (HaMuSV), murine mammary tumor virus (MuMTV), gibbon ape leukemia virus (GaLV), feline leukemia virus (FLV), spumavirus, Friend murine leukemia virus, Murine Stem Cell Virus (MSCV) and Rous Sarcoma Virus (RSV)) and lentivirus. Non-limiting examples of lentiviruses include human immunodeficiency virus (e.g., HIV type 1 and HIV type 2), visna-maedi virus (VMV), caprine arthritis-encephalitis virus (CAEV), equine infectious anemia virus (EIAV), feline immunodeficiency virus (FIV), bovine immune deficiency virus (BIV), and simian immunodeficiency virus (SIV). In some embodiments, a retroviral vector comprises a lentiviral vector or a gammaretroviral vector. In some embodiments, a retroviral vector comprises a lentiviral vector. In some embodiments, a retroviral vector comprises a gammaretroviral vector.

In some embodiments, a gene delivery system comprises an adeno viral vector. In some embodiments, an adeno viral vector comprises AD100.

In some embodiments, a gene delivery system comprises a herpes simplex viral vector. In some embodiments, a herpes simplex viral vector comprises HSV-2.

In some embodiments, a gene delivery system comprises a transposon vector.

In some embodiments, a gene delivery system comprises a non-viral gene-delivery system. In some embodiments, a non-viral nucleic acid vector comprises nanoparticles. In some embodiments, nanoparticles are organic (e.g., lipid and/or polymer). In some embodiments, nanoparticles are inorganic. Nanoparticles are well known in the art. Any suitable nanoparticle design can be used to deliver a polynucleotide or vector disclosed herein into a cell or subject. In some embodiments, a gene delivery system comprises lipid nanoparticles. In some embodiments, a gene delivery system comprises polymer nanoparticles.

In some embodiments, a polynucleotide is delivered into a target cell by transfection (e.g., DNA transfection). Non-limiting transfection methods include cationic agent-mediated transfection, cationic facial amphiphiles (CFAs) (Nat. Biotechnol. (1996) 14: 556), compacted DNA-mediated transfection, DNA biolistics, electroporation, immunoliposomes, lipid-mediated transfection, lipofectin, and liposomes.

In some embodiments, a fusion protein is delivered to a target cell by protein transduction. In some embodiments, protein transduction is via vector delivery. See, e.g., Cai et al., Targeted genome editing by lentiviral protein transduction of zinc-finger and TAL-effector nucleases, Elife 3:e01911 (2014); Maetzig et al., Retroviral protein transfer: falling apart to make an impact, Curr Gene Ther. 12(5):389-409 (2012). In some embodiments, protein transduction is via protein delivery. See, e.g., Gaj et al., Targeted gene knockout by direct delivery of zinc-finger nuclease proteins, Nat Methods. 9(8):805-7 (2012). In some embodiments, a fusion protein is delivered to a target cell using a vehicle (e.g., liposomes). In some embodiments, a fusion protein is administered to a target cell.

LNPs

In some embodiments, a gene delivery system comprises a non-viral gene-delivery system. In some embodiments, a non-viral nucleic acid vector comprises nanoparticles. In some embodiments, nanoparticles are organic (e.g., lipid and/or polymer). In some embodiments, nanoparticles are inorganic. Nanoparticles are well known in the art. Any suitable nanoparticle design can be used to deliver a polynucleotide or vector disclosed herein into a cell or subject. In some embodiments, a gene delivery system comprises lipid nanoparticles. In some embodiments, a gene delivery system comprises polymer nanoparticles.

In some embodiments, a fusion protein disclosed herein is introduced into a target cell or into a target tissue by contacting the target cell or target tissue with a lipid nanoparticle (LNP) comprising (e.g., encapsulating) the fusion protein or a nucleic acid, for example, an mRNA, encoding the fusion protein. In some embodiments, for example, in embodiments where the fusion protein comprises a dCas9 DNA-binding domain, the LNP may further comprise a guide RNA, e.g., an sgRNA, or a nucleic acid molecule encoding a guide RNA. In some embodiments, the target cells are hepatocytes. In some embodiments, the target tissue is liver.

Some suitable LNPs, and methods of formulating payloads, including, for example, proteins and/or nucleic acids, into LNPs, as well as methods of contacting cells or tissues in vitro, ex vivo, or in vivo, with payloads formulated into LNPs, are disclosed herein, and other suitable LNPs, methods of formulation, and methods of delivering payloads to cells or tissues in vitro, ex vivo, and in vivo will be apparent to the skilled artisan in view of the present disclosure and the knowledge in the art. The disclosure is not limited in this respect.

Some aspects of this disclosure provide a fusion protein disclosed herein, or a nucleic acid encoding such a fusion protein, formulated into an LNP. Some aspects of this disclosure provide an LNP comprising a payload disclosed herein, e.g., a fusion protein, a nucleic acid. e.g., an mRNA, encoding such a fusion protein, and, optionally, a guide RNA. In some embodiments, the LNP is for delivery of the fusion protein, or the nucleic acid encoding the fusion protein, to a target cell or tissue in vitro, ex vivo, or in vivo. In some embodiments, the LNP is for administration to a subject in need thereof, e.g., a human subject, a non-human primate subject, or a mammalian subject.

In some embodiments, the LNP comprises a fusion protein provided herein. In some embodiments, the LNP comprises a nucleic acid, for example, an mRNA, encoding a fusion protein provided herein. In some embodiments, the fusion protein comprises a dCas9 DNA-binding domain, and the LNP further comprises a gRNA. In some embodiments, the LNP comprises a nucleic acid encoding a fusion protein provided herein and a gRNA.

In some embodiments, the LNP comprising (e.g., encapsulating) a fusion protein provided herein, or a nucleic acid, for example, an mRNA, encoding the fusion protein, is a liposome. In some embodiments, the LNP comprises a cationic lipid. In some embodiments, the LNP comprises a cationic lipid-nucleic acid complex. In some embodiments, the LNP is a solid lipid nanoparticle. In some embodiments, the LNP is a nanostructured lipid carrier.

In some embodiments, the LNP comprises at least one lipid. In some embodiments, the LNP comprises two lipids. In some embodiments, the LNP comprises three lipids. In some embodiments, the LNP comprises four lipids. In some embodiments, the LNP comprises more than four lipids.

In some embodiments, the LNP comprising (e.g., encapsulating) the fusion protein or a nucleic acid, for example, an mRNA, encoding the fusion protein, comprises a cationic lipid or a non-cationic lipid, or a combination of a cationic and a non-cationic lipid. In some embodiments, the LNP comprises an ionizable cationic lipid. In some embodiments, the non-cationic lipid comprises a phospholipid and/or cholesterol or a cholesterol derivative, or a combination of a phospholipid and cholesterol or a cholesterol derivative. In some embodiments, the LNP comprises a conjugated lipid. For example, in some embodiments, the LNP comprises a cationic lipid, a non-cationic lipid, and a conjugated lipid. In some embodiments, the conjugated lipid is a polymer-conjugated lipid. In some embodiments, the conjugated lipid is a PEG-conjugated (PEGylated) lipid. In some embodiments, the LNP further comprises a steroid. In some embodiments, the LNP comprises an amino lipid. In some embodiments, the LNP comprises an imino lipid. In some embodiments, the LNP comprises or is conjugated to an N-acetylgalactosamine (GalNAC) moiety.

Suitable cationic lipids may include, in some embodiments, DLin-DMA (1,2-dilinoleyloxy-3-dimethylaminopropane), DLin-MC3-DMA (dilinoleylmethyl-4-dimethylaminobutyrate), DLin-KC2-DMA (2,2-dilinoleyl-4-(2-dimethylaminoethyl)-[1,3]-dioxolane), DODMA (1,2-dioleyloxy-N,N-dimethyl-3-aminopropane), DOTAP (1,2-dioleoyl-3-trimethylammonium-propane), DOTMA (1,2-di-O-octadecenyl-3-trimethylammonium propane), GUADACA (guanidino-dialkyl acid), MPDACA (methylpyridiyl-dialkyl acid), PONA (palmitoyl-oleoyl-nor-arginine), SS18/4PE13 (Bis{2-[4-(cis,cis-9,12-octadecadienoateethyl)-1-piperidinyl]ethyl} disulfide), SS18/4PE16 (Bis{2-[4-(cis-9-octadecenoateethyl)-1-piperidinyl] ethyl} disulfide), SS-33/3AP05 (Bis{2-[N-methyl-N-(α-D-tocopherolhemisuccinatepropyl)amino]ethyl}disulfide), SS33/4PE15 (Bis{2-[4-(α-D-tocopherolhemisuccinateethyl)piperidyl] ethyl} disulfide), SS-OP (Bis[2-(4-{2-[4-(cis-9 octadecenoyloxy)phenylacetoxy]ethyl}piperidinyl)ethyl] disulfide), 98N12-5 (N1,N16-didodecyl-4,7,13-tris[3-(dodecylamino)-3-oxopropyl]-4,7,10,13-tetraazahexadecanediamide), C12-200 (1,1'-[[2-[4-[2-[[2-[bis(2-hydroxydodecyl) amino]ethyl](2-hydroxydodecyl)amino]ethyl]-1-piperazinyl]ethyl]imino]bis-2-dodecanol), or a derivative of any thereof, or any combination thereof.

In some embodiments, the LNP comprises a non-cationic lipid. In some embodiments, the non-cationic lipid comprises a phospholipid. In some embodiments, the non-cationic lipid comprises a steroid. Suitable steroids include, but are not limited to, cholestanes (e.g., cholesterol), cholanes (e.g., cholic acid), pregnanes (e.g., progesterone), androstanes, e.g., testosterone, and estranes (e.g., estradiol). In some embodiments, the LNP comprises cholesterol, cholesterol sulfate, desmosterol-d6, cholesterol-d7, lathosterol-d7, desmosterol, stigmasterol, lanosterol, dehydrocholesterol, dihydrolanosterol, zymosterol, lathosterol, zymosterol-d5, 14-demethyl-lanosterol, 14-demethyl-lanosterol-d6, 8(9)-dehydrocholesterol, 8(14)-dehydrocholesterol, diosgenin, DHEA sulfate, DHEA, lanosterol-d6, dihydrolanosterol-d7, campesterol-d6, sitosterol, lanosterol-95, Dihydro µF-MAS-d6, zymostenol-d7, zymostenol, sitostanol, campestanol, campesterol, 7-dehydrodesmosterol, pregnenolone, sitosterol-d7, Dihydro T-MAS, Delta 5-avenasterol, Brassicasterol, Dihydro FF-MAS, 24-methylene cholesterol, a cholic acid derivative, a cholesteryl ester, or a glycosylated sterol, or a derivative of any thereof, or any combination thereof. In some embodiments, the lipid nanoparticles comprise cholesterol.

In some embodiments, the LNP comprises a PEG-conjugated (PEGylated) lipid. In some embodiments, the LNP comprises two or more PEGylated lipids. In some embodiments, the LNP comprises a PEGylated phosphatidylethanolamine, a PEGylated phosphatidic acid, a PEGylated ceramide, a PEGylated dialkylamine, a PEGylated diacylglycerol, a PEGylated dialkylglycerol, or a mixture of two or more of any of the foregoing. For example, the one or more PEG-lipids can comprise one or more PEGylated phosphatidylethanolamines (PEGylated PEs), e.g., DSPE-PEG, DPPE-PEG, DOPE-PEG, DMPTE-PEG; one or more mPEGylated glycerides, e.g., DMG-PEG, DSG-PEG, DPG-PEG; one or more mPEGylated PEs, e.g., DSPE-mPEG, DPPE-mPEG, DMPE-mPEG; one or more amino-mPEGs, e.g., ALC-0159; and/or one or more Cholesterol-PEGs, e.g., cholesterol-mPEG, cholesterol-PG, or any combination thereof. In some embodiments, the PEGylated lipid comprises a linear or branched poly-ethylene glycol or poly-ethylene oxide polymer, or any combination thereof. In some embodiments, the PEGylated lipid comprises a PEG moiety that is substituted, e.g., by an alkyl, alKOXly, acyl, hydroxy, or aryl group, or a plurality of such groups or any combination thereof. In some embodiments, the PEGylated lipid comprises a PEG copolymer. In some embodiments, the PEG-copolymer is PEG-polyurethane or PEG-polypropylene or a combination thereof.

In some embodiments, the LNP comprises a GalNAC-conjugated lipid. In some embodiments, the GalNAC-conjugated lipid is a GalNAc-PEG lipid.

In Some embodiments, the LNP comprises a cationic, e.g., ionizable cationic, lipid, a non-cationic lipid, and a conjugated lipid. For example, in some embodiments, the LNP comprises an ionizable cationic lipid, a non-cationic lipid, and a conjugated lipid. In some embodiments, the molar concentration of the cationic lipid is from about 20% to about 80%, from about 30% to about 70%, from about 40% to about 60%, from about 40% to about 50%, from about 45% to about 55%, or about 20%, about 25%, about 30%, about 35%, about 40%, about 45%, about 50%, about 55%, about 60%, about 65%, about 70%, about 75%, or about 80% of the total lipid molar concentration, wherein the total lipid molar concentration is the sum of the cationic lipid, the non-cationic lipid, and the lipid conjugate molar concentrations. In some embodiments, the molar concentration of the non-cationic lipids is from about 20% to about 80%, from about 30% to about 70%, from about 40% to about 70%, from about 40% to about 60%, from about 46% to about 50%, or about 20%, about 25%, about 30%, about 35%, about 40%, about 45%, about 48.5%, about 50%, about 55%, about 60%, about 65%, about 70%, about 75%, or about 80% of the total lipid molar concentration. In some embodiments, the molar concentration of the conjugated lipid is between about 0% to about 2%, for example, from about 0.5% to about 2%, from about 0.5% to about 1%, from about 0.5% to about 1.5%, from about 1% to about 2%, from about 1% to about 1.5%, from about 1% to about 1.2%, at or about 0.2%, at or about 0.3%, at or about 0.4%, at or about 0.5%, at or about 0.6%, at or about 0.7%, at or about 0.8%, at or about 0.9%, at or about 1.0%, at or about 1.1%, at or about 1.2%, at or about 1.3%, at or about 1.4%, at or about 1.5%, at or about 1.6%, at or about 1.7%, at or about 1.8%, at or about 1.9%, at or about 2.0%, or more, or a value in between any of the foregoing.

In some embodiments, the LNP comprises (e.g., encapsulates) a nucleic acid encoding a fusion protein provided herein, and optionally, a gRNA, and comprises a molar ratio of cationic lipid to the nucleic acid, or, where the LNP also comprises a gRNA, a molar ratio of cationic lipid to the sum of nucleic acid and gRNA, of from about 1 to about 20, from about 2 to about 16, from about 4 to about 12, from about 6 to about 10, or about 1, about 2, about 3, about 4, about 5, about 6, about 7, about 8, about 9, about 10, about 11, about 12, about 13, about 14, about 15, about 16, about 17, about 18, about 19, or about 20.

Some suitable LNPs, LNP components, methods of formulating payloads, including, for example, proteins and/or nucleic acids, into LNPs, as well as methods of contacting cells or tissues in vitro, ex vivo, or in vivo, with payloads formulated into LNPs, are disclosed herein, and additional suitable LNPs, LNP components, methods of formulating payloads, including, for example, proteins and/or nucleic acids, into LNPs, as well as methods of contacting cells or tissues will be apparent to the skilled artisan in view of the present disclosure and the knowledge in the art. Non-limiting examples of suitable LNPs, LNP components, formulation methods and methods of contacting cells or tissues include those disclosed in Technov et al., ACS Nano 2021, 15, 16982-17015; Finn et al., Cell Rep. 2018 Feb. 27; 22(9):2227-2235; Gillmore et al., N Engl J Med 2021; 385:493-502; Yan et al., Biomater Sci. 2021 Sep. 14; 9(18): 6001-6011; Kazemian et al., Mol Pharm. 2022 Jun. 6; 19(6):1669-1686; Mohammadian Farsani et al., Heliyon. 2024 Jan. 11; 10(2):e24606; Raguram et al., Cell. 2022 Jul. 21; 185(15):2806-2827; Ma et al., Chembiochem. 2023 May 2; 24(9):e202200801; Kowalski et al., Mol Ther. 2019 Apr. 10; 27(4):710-728; Madigan et al., Nat Rev Drug Discov. 2023 November; 22(11):875-894; Aziz et al., J Biomater Sci Polym Ed. 2023 February; 34(3):398-418; Leung et al., Adv Genet. 2014; 88:71-110; Mok et al., Biochimica et Biophysica Acta, 1999; 1419(2): 137-150; Eldrige, et al., Lipid Nanoparticles: Production, Characterization, and Stability. Springer 2014, ISBN: 3319107100; Prakash et al., Adv Drug Deliv Rev. 2022 May; 184:114197; PCT application publications WO2020206231, WO2015095340, WO2017173054, WO2020219876, WO2015035136, WO2010144740, WO2015199952, WO2017075531, and WO2018081480; U.S. application publications US20040142025, US20070042031, and US2020/0385721; and US Patents U.S. Pat. Nos. 7,745,651, 7,799,565, 7,901,708, 8,058,069, 8,158,601, 8,492,359, 8,642,076, 8,822,668, 9,005,654, 9,006,417, 9,139,554, 9,364,435, 9,404,127, 9,415,109, 9,518,272, 9,593,077, 9,682,139, 9,878,042, 9,999,673, 10,723,692, 10,941,395, 11,141,378; the contents of each of which are incorporated herein by reference.

The skilled artisan will be able to select the components of the LNP, as well as their molar ratios, of the components to each other and to the respective payload, and suitable methods for the preparation of such LNPs, based on the present disclosure and the knowledge in the art without undue experimentation.

Compositions, Pharmaceutical Compositions & Kits

Also provided herein, among other things, is a composition comprising any one or more of the fusion proteins, polynucleotides, vectors, or gene delivery systems disclosed herein, or any combination of the foregoing.

In some embodiments, a composition is a pharmaceutical composition.

In some embodiments, a composition (e.g., pharmaceutical composition) comprises one or more pharmaceutically acceptable carriers, excipients, stabilizers, diluents or tonifiers (Remington's Pharmaceutical Sciences 16th edition, Osol, A. Ed. (1980)). Suitable pharmaceutically acceptable carriers, excipients, or stabilizers are nontoxic to recipients at the dosages and concentrations employed. Non-limiting examples of pharmaceutically acceptable carriers, excipients, stabilizers, diluents or tonifiers include buffers (e.g., phosphate, citrate, histidine), antioxidants (e.g., ascorbic acid or methionine), preservatives, proteins (e.g., serum albumin, gelatin or immunoglobulins); hydrophilic polymers, amino acids, carbohydrates (e.g., monosaccharides, disaccharides, glucose, mannose or dextrins); chelating agents (e.g., EDTA), sugars (e.g., sucrose, mannitol, trehalose or sorbitol), salt-forming counter-ions (e.g., sodium), metal complexes (e.g., Zn-protein complexes); non-ionic surfactants (e.g., Tween), PLURONICS™ and polyethylene glycol (PEG).

In some embodiments, a composition (e.g., pharmaceutical composition) disclosed herein is formulated for a suitable administration schedule and route. Non-limiting examples of administration routes include oral, rectal, mucosal, intravenous, intramuscular, subcutaneous and topical, etc. In some embodiments, the composition (e.g., pharmaceutical composition) disclosed herein is stored in the form of an aqueous solution or a dried formulation (e.g., lyophilized).

In some embodiments, a composition (e.g., pharmaceutical composition) is formulated to be administered by intrathecal administration.

In some embodiments, a composition (e.g., pharmaceutical composition) is formulated to be administered by bilateral intracerebroventricular injection.

In some embodiments, a composition is formulated to be administered by infusion (e.g., intravenous infusion). In some embodiments, a composition (e.g., pharmaceutical composition) comprises pharmaceutically acceptable carriers, excipients, stabilizers, diluents or tonifiers (Remington's Pharmaceutical Sciences 16th edition, Osol, A. Ed. (1980)). Suitable pharmaceutically acceptable carriers, excipients, or stabilizers are nontoxic to recipients at the dosages and concentrations employed. Non-limiting examples of pharmaceutically acceptable carriers, excipients, stabilizers, diluents or tonifiers include buffers (e.g., phosphate, citrate, histidine), antioxidants (e.g., ascorbic acid or methionine), preservatives, proteins (e.g., serum albumin, gelatin or immunoglobulins); hydrophilic polymers, amino acids, carbohydrates (e.g., monosaccharides, disaccharides, glucose, mannose or dextrins); chelating agents (e.g., EDTA), sugars (e.g., sucrose, mannitol, trehalose or sorbitol), salt-forming counter-ions (e.g., sodium), metal complexes (e.g., Zn-protein complexes); non-ionic surfactants (e.g., Tween), PLURONICS™ and polyethylene glycol (PEG).

In some embodiments, a composition (e.g., pharmaceutical composition) disclosed herein is formulated for a suitable administration schedule and route. Non-limiting examples of administration routes include oral, rectal, mucosal, intravenous, intramuscular, subcutaneous and topical, etc. In some embodiments, the composition (e.g., pharmaceutical composition) disclosed herein is stored in the form of an aqueous solution or a dried formulation (e.g., lyophilized).

In some embodiments, a composition is formulated to be administered by infusion (e.g., intravenous infusion).

Also provided herein, among other things, is a kit comprising a container and, optionally, an instruction for use, wherein the container comprises any one or more of the fusion proteins, polynucleotides, vectors, gene delivery systems, compositions, or pharmaceutical compositions disclosed herein, or any combination of the foregoing.

Cells

Also provided herein, among other things, is a cell comprising any one or more of the fusion proteins, polynucleotides, vectors, or gene delivery systems disclosed herein, or any combination of the foregoing.

Also provided herein, among other things, is a progeny cell derived from a cell comprising any one or more of the fusion proteins, polynucleotides, vectors, or gene delivery systems disclosed herein, or any combination of the foregoing.

In some embodiments, a cell is in vitro or ex vivo. In some embodiments, a cell is in vivo.

A cell may reside in or obtained (e.g., isolated) from a biological entity containing expressed genetic materials. The biological entity may be a plant, animal, or microorganism. In some embodiments, a cell resides in a biological entity or a tissue. In some embodiments, a cell or its progeny was obtained (e.g., isolated) from a biological entity in vivo. In some embodiments, a cell or its progeny is cultured in vitro.

In some embodiments, a cell is an animal cell, a fungal cell (such as a yeast), or a plant cell. In some embodiments, a cell is a mammalian cell. In some embodiments, a mammal cell is selected from a dog cell, a cat cell, a mouse cell, a rat cell, a hamster cell, a guinea pig cell, a horse cell, a pig cell, a sheep cell, a cow cell, a chimpanzee cell, a macaque cell, a cynomolgus monkey cell, and a human cell. In some embodiments, a cell is derived from a primate (e.g., a human or a non-human primate). In some embodiments, a cell is a human cell.

In some embodiments, a cell is a neural stem cell. In some embodiments, a cell is a brain cell. In some embodiments, a cell is a neuron. In some embodiments, a cell is a hematopoietic stem cell. In some embodiments, a cell is a hematopoietic progenitor cell. In some embodiments, a cell is a T lymphocyte. In some embodiments, a cell is a monocyte. In some embodiments, a cell is a mesenchymal stem cell. In some embodiments, a cell is a fibroblast. In some embodiments, a cell is an epidermal stem cell.

In some embodiments, a cell disclosed herein expresses a DNMT3 methyltransferase (e.g., a DNMT3A methyltransferase).

Methods of Epigenetic Modification

Also provided herein, among other things, is a method of epigenetically modifying a genomic locus in a cell, comprising delivering to the cell any one or more of the fusion proteins, polynucleotides, or vectors disclosed herein, or any combination of the foregoing.

In some embodiments, a genomic locus is a predetermined genomic locus. In some embodiments, a genomic locus (e.g., predetermined genomic locus) is in a target chromosome comprising a target gene.

In some embodiments, a method comprises delivering a polynucleotide disclosed herein to a cell. In some embodiments, delivering a polynucleotide comprises transfection, viral infection, or delivery by lipid nanoparticles.

In some embodiments, one copy of a polynucleotide is delivered into a cell. In some embodiments, two or more copies of a polynucleotide is delivered into a cell, for example, three or more, four or more, five or more, six to more, seven or more, eight or more, nine or more, or ten or more copies of a polynucleotide is delivered into a cell.

In some embodiments, a method comprises delivering a fusion protein disclosed herein to a cell. In some embodiments, a method comprises delivering a fusion protein disclosed herein together with a sgRNA as a ribonucleoprotein complex.

Designing novel sgRNAs for epigenetic silencing and existing sgRNAs useful for epigenetic silencing (e.g., in human cells or human subjects) are known to those of ordinary skill the art, see, e.g., Nuñez et al., Genome-wide programmable transcriptional memory by CRISPR-based epigenome editing, Cell 184(9):2503-19 (2021) (e.g., Table S3 and Table S6), the entire contents of which are incorporated herein by reference.

In some embodiments, a method comprises delivering a sgRNA or a cr:tracrRNA targeting the genomic locus to the cell. In some embodiments, a method comprises delivering a sgRNA targeting the genomic locus to the cell. In some embodiments, a method comprises delivering a cr:tracrRNA targeting the genomic locus to the cell.

In some embodiments, a genomic locus described herein comprises cytosine-guanine dinucleotides (CpGs). CpG regions (e.g., promoter CpG regions) amenable to targeted DNA (and/or histone) methylation are known to those of ordinary skill the art, see, e.g., Nunez et al., Genome-wide programmable transcriptional memory by CRISPR-based epigenome editing, Cell 184(9):2503-19 (2021) (e.g., Table S2), the entire contents of which are incorporated herein by reference.

In some embodiments, a genomic locus described herein lacks CpGs.

In some embodiments, a cell disclosed herein expresses a DNMT3 methyltransferase (e.g., a DNMT3A methyltransferase), and a fusion protein disclosed herein recruits one or more DNMT3 methyltransferases to a genomic locus in the cell.

In some embodiments, a DNMT3 methyltransferase-binding domain specifically binds to a DNMT3 methyltransferase (e.g., DNMT3A) in a cell comprising a target gene (e.g., a PRNP gene) and directs the DNMT3 methyltransferase to the target gene to effect an epigenetic modification in a nucleotide in the target gene.

In some embodiments, a site-specific epigenetic modification is within about 3,000 base pairs (e.g., upstream or downstream) of a target sequence. In some embodiments, a site-specific epigenetic modification is within about 2,000 base pairs (e.g., upstream or downstream) of a target sequence.

In some embodiments, a site-specific epigenetic modification is within 3,000 base pairs (e.g., upstream or downstream) of an expression regulatory sequence, for example, within about: 2,900, 2,800, 2,700, 2,600, 2,500, 2,400, 2,300, 2,200, 2,100, 2,000, 1,900, 1,800, 1,700, 1,600, 1,500, 1,400, 1,300, 1,200, 1,100, 1,000, 900, 800, 700, 600, 500, 400, 300, 200 or 100, base pairs (e.g., upstream or downstream) of an expression regulatory sequence. In some embodiments, a site-specific epigenetic modification is within 2,000 base pairs (e.g., upstream or downstream) of an expression regulatory sequence, for example, within about: 1,900, 1850, 1,800, 1750, 1,700, 1,650, 1,600, 1,550, 1,500, 1,450, 1,400, 1,350, 1,300, 1,250, 1,200, 1,150, 1,100, 1,050, 1,000, 950, 900, 850, 800, 750, 700, 650, 600, 550, 500, 450, 400, 350, 300, 250, 200, 150, 100, 90, 80, 70, 60 or 50, base pairs (e.g., upstream or downstream) of an expression regulatory sequence. In some embodiments, a site-specific epigenetic modification is within 1,000 base pairs (e.g., upstream or downstream) of an expression regulatory sequence, for example, within about: 950, 900, 850, 800, 750, 700, 650, 600, 550, 500, 450, 400, 350, 300, 250, 200, 150, 100, 95, 90, 85, 80, 75, 70, 65, 60, 55 or 50, base pairs (e.g., upstream or downstream) of an expression regulatory sequence.

In some embodiments, an epigenetic modification is within a coding region of a target gene. In some embodiments, a target gene comprises an allele associated with a disease.

In some embodiments, a DNA-binding domain binds to a genomic locus, e.g., a predetermined genomic locus in a target chromosome comprising a target gene.

In some embodiments, epigenetically modifying a genomic locus comprises methylating DNA at or near the genomic locus.

In some embodiments, epigenetically modifying a genomic locus comprises post-translational histone methylation. In some embodiments, post-translational histone methylation comprises H3K9 trimethylation, H3K27 methylation, or both. In some embodiments, post-translational histone methylation comprises H3K9 trimethylation. In some embodiments, post-translational histone methylation comprises H3K27 methylation. In some embodiments, post-translational histone methylation is transient.

In some embodiments, a genomic locus described herein includes a target gene.

In some embodiments, epigenetically modifying a genomic locus modifies (e.g., decreases or silences) transcription and/or expression of a target gene.

In some embodiments, epigenetically modifying a genomic locus decreases the level of transcription of a target gene by at least about 10%, for example, at least about: 15%, 20%, 25%, 30%, 40%, 50%, 60%, 70%, 80%, 90%, 91%, 92%, 93%, 94%, 95%, 96%, 97%, 98%, or 99%, compared to the level of transcription in the absence of epigenetic modification. In some embodiments, epigenetically modifying a genomic locus decreases the level of transcription of a target gene by at least about 50%. In some embodiments, epigenetically modifying a genomic locus decreases the level of transcription of a target gene by at least about 90%. In some embodiments, epigenetically modifying a genomic locus decreases the level of transcription of a target gene by at least about 95%. In some embodiments, epigenetically modifying a genomic locus decreases the level of transcription of a target gene by at least about 99%. In some embodiments, epigenetically modifying a genomic locus decreases the level of transcription of a target gene by about 100%.

In some embodiments, epigenetically modifying a genomic locus decreases the level of expression of a target gene by at least about 10%, for example, at least about: 15%, 20%, 25%, 30%, 40%, 50%, 60%, 70%, 80%, 90%, 91%, 92%, 93%, 94%, 95%, 96%, 97%, 98%, or 99%, compared to the level of expression in the absence of epigenetic modification. In some embodiments, epigenetically modifying a genomic locus decreases the level of expression of a target gene by at least about 50%. In some embodiments, epigenetically modifying a genomic locus decreases the level of expression of a target gene by at least about 90%. In some embodiments, epigenetically modifying a genomic locus decreases the level of expression of a target gene by at least about 95%. In some embodiments, epigenetically modifying a genomic locus decreases the level of expression of a target gene by at least about 99%. In some embodiments, epigenetically modifying a genomic locus decreases the level of expression of a target gene by about 100%.

In some embodiments, an epigenetic modification is reversible. For example, DNA methylation may be reversed by passive demethylation or by active oxidation, for example, by one or more ten eleven translocation (TET) enzymes.

Also provided herein, among other things, is an epigenetically-modified cell produced by any one or more of the methods disclosed herein, or a progeny cell thereof.

In some embodiments, an epigenetic modification disclosed herein is performed in a clinical or laboratory setting. Non-limiting examples of clinical or laboratory settings include a clinic, a hospital, a pathology laboratory, a pharmacy, and a research laboratory (e.g., within an academic institution, a research institution or a pharmaceutical company).

In some embodiments, expression of a fusion protein disclosed herein (an epi-editor) is self-silenceable.

In some embodiments, an epi-editor silences its expression by targeting its recognition sequence located upstream and/or downstream of its promoter.

In some embodiments, a polynucleotide and/or a vector encoding an epi-editor comprises a DNA-binding domain recognition sequence upstream and/or downstream of a promoter (which initiates transcription of the epi-editor). In some embodiments, a DNA-binding domain is a component of an epi-editor encoded by the polynucleotide and/or vector. In some embodiments, a vector encoding an epi-editor comprises a DNA-binding domain recognition sequence upstream of a promoter. In some embodiments, a vector encoding an epi-editor comprises a DNA-binding domain recognition sequence downstream of a promoter. In some embodiments, dissociation between the DNA-binding domain recognition sequence and the DNA-binding domain is faster than dissociation between a DNA-binding domain recognition sequence in a target gene and the DNA-binding domain. In some embodiments, the dissociation rate is at least about 10% higher, for example, at least about: 20%, 30%, 40%, 50%, 60%, 80%, 100%, 200%, 500%, or 1000% higher. In some embodiments, the dissociation rate is about 10% to 1,000% higher, for example, about: 20% to 1,000% higher, 20% to 500% higher, 30% to 500% higher, 30% to 200% higher, 40% to 200% higher, 40% to 100% higher, 50% to 100% higher, 50% to 80% higher, or 60% to 80% higher.

In some embodiments, a DNA-binding domain recognition sequence is about 1-1,500 base pairs upstream of a promoter, for example, about: 1-1,250, 1-1,000, 1-750, 1-500, 1-400, 1-300, 1-250, 1-200, 1-150, 1-100 or 1-50 base pairs upstream of a promoter. In some embodiments, a DNA-binding domain recognition sequence is about 1-1,500 base pairs downstream of a promoter, for example, about: 1-1,250, 1-1,000, 1-750, 1-500, 1-400, 1-300, 1-250, 1-200, 1-150, 1-100 or 1-50 base pairs downstream of a promoter.

In some embodiments, the DNA-binding domain recognition sequence in a vector has less than 100% sequence identity to a DNA-binding domain recognition sequence in a target gene, for example, the DNA-binding domain recognition sequence has about: 75%-99%, 75%-95%, 75%-90%, 75%-85%, 75%-80%, 80%-99%, 80%-95%, 80%-90%, 80%-85%, 85%-99%, 85%-95%, 85%-90%, 90%-99%, 90%-95%, or 95%-99% sequence identity to a DNA-binding domain recognition sequence in a target gene.

In some embodiments, a fusion protein promoter flanking sequence (e.g., upstream and/or downstream of the promoter) comprises a nucleotide sequence having at least about 80% sequence identity to at least one sequence set forth in SEQ ID NOs:404-415, for example, has at least about: 85%, 88%, 90%, 91%, 92%, 93%, 94%, 95%, 96%, 97%, 98%, or 99% sequence identity to at least one sequence set forth in SEQ ID NOs:404-415. In some embodiments, the sequence has about: 80-99%, 80-98%, 85-98%, 85-97%, 88-97%, 88-96%, 90-96%, or 90-95% sequence identity to at least one sequence set forth in SEQ ID NOs:404-415. In some embodiments, fusion protein promoter flanking sequence (e.g., upstream and/or downstream of the promoter) comprises a nucleotide sequence having 100% sequence identity to a sequence set forth in SEQ ID NOs: 404-415.

In some embodiments, a fusion protein promoter flanking sequence (e.g., upstream and/or downstream of the promoter) comprises a nucleotide sequence having at least about 80% sequence identity to the nucleotide sequence set forth in SEQ ID NO:406, for example, has at least about: 85%, 88%, 90%, 91%, 92%, 93%, 94%, 95%, 96%, 97%, 98%, or 99% sequence identity to the nucleotide sequence set forth in SEQ ID NO:406. In some embodiments, the sequence has about: 80-99%, 80-98%, 85-98%, 85-97%, 88-97%, 88-96%, 90-96%, or 90-95% sequence identity to the nucleotide sequence set forth in SEQ ID NO:406. In some embodiments, a fusion protein promoter flanking sequence (e.g., upstream and/or downstream of the promoter) comprises a nucleotide sequence having 100% sequence identity to the nucleotide sequence set forth in SEQ ID NO:406.

In some embodiments, an epi-editor comprises a first DNA-binding domain and a second DNA-binding domain, wherein the first DNA-binding domain binds to a DNA-binding domain recognition sequence in a target gene, and a second DNA-binding domain binds to a DNA-binding domain recognition sequence present in the polynucleotide that encodes the epi-editor (e.g., upstream and/or downstream of the promoter).

In some embodiments, a self-silencing epi-editor comprises a CRISPR-associated protein (e.g., dCas9).

In some embodiments, a cell comprising a self-silencing epi-editor further comprises a sgRNA. In some embodiments, the sgRNA targets a first sequence (e.g., within a promoter/transcriptional regulatory region) that controls transcription of the epi-editor, and a second sequence (e.g., within a promoter/transcriptional regulatory region) that controls transcription of a target gene. In some embodiments, dissociation between the sgRNA and the first sequence is faster than dissociation between the sgRNA and the second sequence. In some embodiments, the dissociation rate is at least about 10% higher, for example, at least about: 20%, 30%, 40%, 50%, 60%, 80%, 100%, 200%, 500%, or 1000% higher. In some embodiments, the dissociation rate is about 10% to 1,000% higher, for example, about: 20% to 1,000% higher, 20% to 500% higher, 30% to 500% higher, 30% to 200% higher, 40% to 200% higher, 40% to 100% higher, 50% to 100% higher, 50% to 80% higher, or 60% to 80% higher.

In some embodiments, a cell comprising a self-silencing epi-editor further comprises a first sgRNA and a second sgRNA, wherein the first sgRNA targets a first sequence (e.g., within a promoter/transcriptional regulatory region) that controls transcription of the epi-editor, and the second sgRNA targets a second sequence (e.g., within a promoter/transcriptional regulatory region) that controls transcription of a target gene. In some embodiments, dissociation between the first sgRNA and the first sequence is faster than dissociation between the second sgRNA and the second sequence. In some embodiments, the dissociation rate is at least about 10% higher, for example, at least about: 20%, 30%, 40%, 50%, 60%, 80%, 100%, 200%, 500%, or 1000% higher. In some embodiments, the dissociation rate is about 10% to 1,000% higher, for example, about: 20% to 1,000% higher, 20% to 500% higher, 30% to 500% higher, 30% to 200% higher, 40% to 200% higher, 40% to 100% higher, 50% to 100% higher, 50% to 80% higher, or 60% to 80% higher.

Methods of Treatment

Also provided herein, among other things, is a method of treating a disease (e.g., a condition) in a subject in need thereof, comprising administering to the subject any one or more of the fusion proteins, polynucleotides, gene delivery systems, compositions, pharmaceutical compositions, or cells disclosed herein. In some embodiments, a method of treating a disease comprises administering to a subject a fusion protein disclosed herein together with a sgRNA as a ribonucleoprotein complex.

In some embodiments, a disease is a genetic disease. Non-limiting examples of genetic diseases include Alzheimer's disease (AD), arrhythmogenic right ventricular dysplasia/cardiomyopathy (ARVD/C), arthritis, autism spectrum disorder, Brugada syndrome, cancer, Charcot-Marie-Tooth disease, cleft lip and palate, cleidocrandial dyspladia, cystic fibrosis, diabetes, Down syndrome, familial adenomatous polyposis, fragile X (FXS) syndrome, Hirshsprungs disease, Huntington's disease (HD), Klienfelter syndrome, Kneist syndrome, Marfan syndrome, mucopolysaccharidoses, muscular dystrophy, sickle cell disease, spina bifida, Tay-Sachs disease, triple-X syndrome, Turner syndrome, trisomy 13, trisomy 18, and Von Hippel-Lindau. In some embodiments, a genetic disease is a Huntington's disease.

In some embodiments, a disease is a neurological disorder.

In some embodiments, a neurological disorder is a central nervous system (CNS) disorder. In some embodiments, a CNS disorder is stroke, multiple sclerosis, or a neurodegenerative disorder. In some embodiments, a neurodegenerative disorder is Alzheimer's disease (AD), Parkinson's disease (PD), Huntington's disease (HD) or a prion disease.

In some embodiments, a disease is Huntington's disease (HD).

In some embodiments, a disease is a prion disease. Non-limiting prion diseases include Creutzfeldt-Jakob disease (CJD), variant Creutzfeldt-Jakob disease (vCJD), Gerstmann-Straussler-Scheinker syndrome, fatal familial insomnia, Kuru, bovine spongiform encephalopathy (BSE), chronic wasting disease (CWD), scrapie, transmissible mink encephalopathy, feline spongiform encephalopathy, and ungulate spongiform encephalopathy. In some embodiments, a prion disease is Creutzfeldt-Jakob disease (CJD), variant Creutzfeldt-Jakob disease (vCJD), Gerstmann-Straussler-Scheinker syndrome, fatal familial insomnia, or Kuru. In some embodiments, a prion disease is Creutzfeldt-Jakob disease (CJD). In some embodiments, a prion disease is fatal familial insomnia. In some embodiments, a prion disease is bovine spongiform encephalopathy (BSE), chronic wasting disease (CWD), scrapie, transmissible mink encephalopathy, feline spongiform encephalopathy, and ungulate spongiform encephalopathy.

In some embodiments, a neurological disorder is a peripheral nervous system (PNS) disorder. Non-limiting PNS disorders include Guillain-Barre syndrome, peripheral neuropathy, and radiculopathy.

In some embodiments, a disease is associated with an increased LDL level in blood. In some embodiments, a disease associated with an increased LDL level in the blood is atherosclerosis, a cardiovascular disease, a coronary heart disease (CVD), dyslipidemia, hypercholesterolemia, or hyperlipidemia, or any combination of the foregoing.

In some embodiments, a disease is associated with heterozygous familial hypercholesterolemia (HeFH), or homozygous familial hypercholesterolemia (HoFH), or both.

In some embodiments, a disease is associated with an increased LDL-C levels. In some embodiments, a subject is at risk of myocardial infarction, stroke, unstable angina, coronary revascularization, or any combination of the foregoing. In some embodiments a disease is an established cardiovascular disease (CVD), ischemic heart disease, or coronary artery disease, or any combination of the foregoing.

In some embodiments, a dyslipidemia is mixed dyslipidemia.

In some embodiments, a hypercholesterolemia is heterozygous familial hypercholesterolemia (HetFH). In some embodiments, a hypercholesterolemia is homozygous familial hypercholesterolemia (HoFH).

In some embodiments, a hyperlipidemia is heterozygous familial hyperlipidemia. In some embodiments, a hyperlipidemia is homozygous familial hyperlipidemia. In some embodiments, a hyperlipidemia is non-familial hyperlipidemia. In some embodiments, a hyperlipidemia is primary hyperlipidemia.

In some embodiments, treating a disorder comprises reducing the expression of a disease associated protein, for example, by reducing transcription from a target gene. Non-limiting examples of target genes include PRNP (prion diseases), HTT (Huntington's disease), Usher syndrome type 2A (USH2A) (associated with retinitis pigmentosa), and APOE (Alzheimer's disease). See, e.g., Ahuja et al., *Epigenetic Therapeutics: A New Weapon in the War Against Cancer*, Annu Rev Med. 67:73-89 (2016) and Byun et al., *Gene Therapy for Huntington's Disease: The Final Strategy for a Cure?* J Mov Disord. 15(1):15-20 (2022), the entire contents of which are incorporated herein by reference.

In some embodiments, a subject has been diagnosed with a disease. In some embodiments, a subject is at risk of developing a disease. In some embodiments, a subject is undergoing a concurrent therapy.

In some embodiments, a subject is a mammalian subject. In some embodiments, a subject is a primate subject. In some embodiments, a subject is a human subject.

In some embodiments, a human subject is a female. In some embodiments, a human subject is a male.

In some embodiments, a human subject is an infant (less than 1 year old). In some embodiments, a human subject is less than 11 years old. In some embodiments, a human subject is 11 years or older. In some embodiments, a human subject is 12 years or older. In some embodiments, a human subject is 12-17 years old. In some embodiments, a human subject is less than 18 years old. In some embodiments, a human subject is an adult (18 years or older). In some embodiments, a human subject is 40 years or older, e.g., at least: 45, 50, 55, 60, 65, 70, 75, 80, 85, 90 years old. In some embodiments, a human subject is elderly (65 years or older). In some embodiments, a human subject is 18 years or older.

In some embodiments, a human subject is between the ages of 18-95 years, for example, 18-85 years, 18-75 years, 18-65 years, 18-55 years, 55-95 years, 55-85 years, 55-75 years, 55-65 years, 65-95 years, 65-85 years, 65-75 years, 75-95 years or 75-85 years. In some embodiments, a human subject is between the ages of 2-12 years, for example, 2-10 years, 2-8 years, 2-6 years, 2-5 years, 2-4 years, 4-12 years, 4-10 years, 4-8 years, 4-6 years, 4-5 years, 5-12 years, 5-10 years, 5-8 years, 5-6 years, 6-12 years, 6-10 years, 6-8 years, 8-12 years, or 8-10 years. In some embodiments, a human subject is between the ages of 6 months to 17 years, for example, 6 months to 16 years, 6 months to 14 years, 6 months to 12 years, 6 months to 10 years, 6 months to 8 years, 6 months to 6 years, 6 months to 4 years, 6 months to 2 years, 1-17 years, 1-16 years, 1-14 years, 1-12 years, 1-10 years, 1-8 years, 1-6 years, 1-4 years, 1-2 years, 2-17 years, 2-16 years, 2-14 years, 2-12 years, 2-10 years, 2-8 years, 2-6 years, 2-4 years, 4-17 years, 4-16 years, 4-14 years, 4-12 years, 4-10 years, 4-8 years, 4-6 years, 6-17 years, 6-16 years, 6-14 years, 6-12 years, 6-10 years, 6-8 years, 8-17 years, 8-16 years, 8-14 years, 8-12 years, 8-10 years, 10-17 years, 10-16 years, 10-14 years, 10-12 years, 12-17 years, 12-16 years, 12-14 years, 14-17 years, or 14-16 years.

In some embodiments, a human subject is ≥6 months, for example, ≥7 months, ≥8 months, ≥9 months, ≥10 months, ≥11 months, ≥1 year, ≥2 years, ≥3 years, 4 years, ≥5 years, 6 years, ≥7 years, ≥8 years, ≥9 years, 10 years, ≥11 years, 12 years, 13 years, 14 years, ≥15 years, 16 years, 17 years, or ≥18 years. In some embodiments, a human subject is 2 years. In some embodiments, a human subject is 12 years. In some embodiments, a human (e.g., a healthy human donor) is 18 years.

In some embodiments, a human subject is about 6 months to about 17 years of age or is about 18 years or older.

A subject to be treated according to the methods disclosed herein may be one who has been diagnosed with a disease, one at risk (e.g., high risk) of developing a disease, or suspected of being at risk (e.g., high risk) for a disease. Diagnosis may be performed by any method or technique known in the art. One skilled in the art will understand that a subject to be treated according to the present disclosure may have been subjected to standard tests or may have been identified, without examination, as one at risk due to the presence of one or more risk factors associated with the disease or condition.

In some embodiments, a method comprises administering to a subject a cell comprising a fusion protein disclosed herein. In some embodiments, a cell is an allogeneic cell. In some embodiments, a cell is an autologous cell.

Embodiments

1. A fusion protein comprising a DNA-binding domain, a DNMT3 methyltransferase-binding domain, and a H3K4me0.

2. The fusion protein of Embodiment 1, wherein the fusion protein lacks nuclease activity.

3. The fusion protein of Embodiment 1 or 2, wherein the DNA-binding domain comprises a DNA-binding domain of a clustered regularly interspaced short palindromic repeats (CRISPR)-associated protein (Cas), a transcription activator-like effector nuclease (TALEN), a zinc finger nuclease (ZFN), a tetracycline-controlled repressor (tetR), a meganuclease, or a homing (HO) endonuclease, or any combination of the foregoing.

4. The fusion protein of any one of Embodiments 1-3, wherein the DNA-binding domain comprises a nuclease-deficient Cas9 (dCas9) or a nuclease-deficient Cpf1 (dCpf1).

5. The fusion protein of any one of Embodiments 1-4, wherein the DNA-binding domain comprises a *Streptococcus pyogenes* dCas9.

6. The fusion protein of any one of Embodiments 1-3, wherein the DNA-binding domain comprises a zinc finger protein (ZFP).

7. The fusion protein of any one of Embodiments 1-3, wherein the DNA-binding domain comprises a leucine zipper domain, a winged helix domain, a helix-turn-helix domain, a helix-loop-helix domain, a chromatin-associated high-mobility group (HMG)-box domain, a white-opaque regulator 3 (Wor3) domain, an oligonucleotide/oligosaccharide-binding (OB)-fold domain, an immunoglobulin domain, or a B3 DNA-binding domain.

8. The fusion protein of any one of Embodiments 1-7, wherein the DNMT3 methyltransferase-binding domain binds a catalytic domain of DNMT3A.

9. The fusion protein of any one of Embodiments 1-8, wherein the DNMT3 methyltransferase-binding domain comprises a DNA methyltransferase 3-like protein (Dnmt3L), or a C-terminal fragment of Dnmt3L.

10. The fusion protein of any one of Embodiments 1-9, wherein the DNMT3 methyltransferase-binding domain comprises an amino acid sequence having at least about 80% sequence identity to at least one sequence set forth in SEQ ID NOs:31-50 and 71-75.

11. The fusion protein of any one of Embodiments 1-10, wherein the DNMT3 methyltransferase-binding domain comprises an amino acid sequence having at least about 80% sequence identity to the sequence set forth in SEQ ID NO:32.

12. The fusion protein of any one of Embodiments 1-11, wherein the H3K4me0 has at least about 80% sequence identity to at least one sequence set forth in SEQ ID NOs:81 and 87.

13. The fusion protein of any one of Embodiments 1-12, wherein the H3K4me0 has at least about 80% sequence identity to the sequence set forth in SEQ ID NO:87.

14. The fusion protein of any one of Embodiments 1-13, further comprising a linker connecting the DNMT3 methyltransferase-binding domain with the H3K4me0.

15. The fusion protein of Embodiment 14, wherein the linker is about 30-50 amino acids in length.

16. The fusion protein of Embodiment 14 or 15, wherein the linker comprises an amino acid sequence set forth in any one of SEQ ID NOs:89-100, SEQ ID NOs:113-128, SEQ ID NO:145 or SEQ ID NO:147.

17. The fusion protein of any one of Embodiments 1-16, comprising, from N-terminus to C-terminus: the H3K4me0, the DNMT3 methyltransferase-binding domain, and the DNA-binding domain.

18. The fusion protein of any one of Embodiments 1-16, comprising, from N-terminus to C-terminus: the H3K4me0, the DNA-binding domain, and the DNMT3 methyltransferase-binding domain.

19. The fusion protein of any one of Embodiments 1-18, wherein:
a) the H3K4me0 has at least about 80% sequence identity to at least one sequence set forth in SEQ ID NOs:81 and 87;
b) the DNMT3 methyltransferase-binding domain has at least about 80% sequence identity to at least one sequence set forth in SEQ ID NOs:31-50 and 71-75; or
c) the DNA-binding domain has at least about 80% sequence identity to the amino acid sequence set forth in SEQ ID NO:1,
or any combination of the foregoing.

20. The fusion protein of any one of Embodiments 1-19, wherein the fusion protein further comprises a Krüppel-associated box domain.

21. The fusion protein of Embodiment 20, wherein the Krüppel-associated box domain has at least about 80% sequence identity to the amino acid sequence set forth in SEQ ID NO:155.

22. The fusion protein of any one of Embodiments 1-21, wherein the fusion protein lacks a DNA methyltransferase catalytic domain.

23. The fusion protein of Embodiment 22, wherein the DNA methyltransferase catalytic domain comprises DNMT3A.

24. The fusion protein of any one of Embodiments 1-23, wherein the fusion protein has at least about 80% sequence identity to at least one sequence set forth in SEQ ID NOs:157-169, 397 and 398.

25. A polynucleotide encoding the fusion protein of any one of Embodiments 1-24.

26. The polynucleotide of Embodiment 25, wherein the polynucleotide is less than or equal to about 6 kilobases (kb) in length.

27. The polynucleotide of Embodiment 25 or 26, wherein the polynucleotide is less than or equal to about 4.7 kb in length.

28. The polynucleotide of any one of Embodiments 25-27, wherein the polynucleotide is a single-stranded linear DNA.

29. A vector comprising the polynucleotide of any one of Embodiments 25-28.

30. The vector of Embodiment 29, wherein the vector is less than or equal to about 6 kb in length.

31. The vector of Embodiment 29 or 30, wherein the vector is less than or equal to about 4.7 kb in length.

32. A gene delivery system comprising the polynucleotide of any one of Embodiments 25-27 or the vector of any one of Embodiments 29-31.

33. The gene-delivery system of Embodiment 32, comprising a viral gene-delivery system.

34. The gene-delivery system of Embodiment 33, wherein the viral gene-delivery system comprises an adeno-associated viral vector, an adenoviral vector, a herpes simplex viral vector, or a retroviral vector, optionally, wherein:
   a) the adeno-associated viral vector comprises a AAV3, AAV3b, AAV4, AAV5, AAV6, AAV7, AAV8, AAV9, AAVrh8, or AAV10 viral vector, or a variant thereof;
   b) the adeno viral vector comprises AD100;
   c) the herpes simplex viral vector comprises HSV-2; or
   d) the retroviral vector comprises a lentiviral vector or a gammaretroviral vector.

35. The gene-delivery system of Embodiment 33 or 34, wherein the viral gene-delivery system comprises an adeno-associated virus (AAV).

36. The gene-delivery system of Embodiment 32, comprising a non-viral gene-delivery system.

37. The gene-delivery system of any one of Embodiments 32-36, further comprising a guide RNA, optionally, wherein the guide RNA is pre-complexed with the fusion protein.

38. A composition comprising the fusion protein of any one of Embodiments 1-24, the polynucleotide of any one of Embodiments 25-27, the vector of any one of Embodiments 29-31, or the gene delivery system of any one of Embodiments 32-37, or any combination of the foregoing.

39. A pharmaceutical composition, comprising the composition of Embodiment 38 and a pharmaceutically acceptable carrier.

40. A kit comprising a container and optionally an instruction for use, wherein the container comprises:
   a) the fusion protein of any one of Embodiments 1-24;
   b) the polynucleotide of any one of Embodiments 25-27;
   c) the vector of any one of Embodiments 29-31;
   d) the gene-delivery system of any one of Embodiments 32-37;
   e) the composition of Embodiment 38; or
   f) the pharmaceutical composition of Embodiment 39, or any combination of the foregoing.

41. The gene-delivery system of Embodiment 37, the composition of Embodiment 38, the pharmaceutical composition of Embodiment 39, or the kit of Embodiment 40, wherein the guide RNA comprises:
   a) a single guide RNA (sgRNA); or
   b) a CRISPR RNA (crRNA) and a trans-activating CRISPR RNA (tracrRNA) (a cr:tracrRNA).

42. A cell, comprising the fusion protein of any one of Embodiments 1-24, the polynucleotide of any one of Embodiments 25-27, the vector of any one of Embodiments 29-31, or the gene delivery system of any one of Embodiments 32-37 and 41, or any combination of the foregoing.

43. A progeny cell derived from the cell of Embodiment 42.

44. The cell of Embodiment 42 or 43, wherein the cell is in vitro or ex vivo.

45. The cell of Embodiment 42 or 43, wherein the cell is in vivo.

46. A method of epigenetically modifying a genomic locus in a cell, comprising delivering to the cell the fusion protein of any one of Embodiments 1-24, the polynucleotide of any one of Embodiments 25-27, or the vector of any one of Embodiments 29-31.

47. The method of Embodiment 46, comprising delivering the polynucleotide of Embodiments 25-27 to the cell.

48. The method of Embodiment 46 or 47, wherein delivering the polynucleotide comprises transfection, viral infection, or delivery by lipid nanoparticles.

49. The method of Embodiment 46, comprising delivering the fusion protein of any one of Embodiments 1-24 to the cell.

50. The method of any one of Embodiments 46-49, further comprising delivering to the cell a sgRNA or a cr:tracrRNA targeting the genomic locus.

51. The method of any one of Embodiments 46-50, wherein the genomic locus comprises cytosine-guanine dinucleotides (CpGs).

52. The method of any one of Embodiments 46-50, wherein the genomic locus lacks cytosine-guanine dinucleotides (CpGs).

53. The method of any one of Embodiments 46-52, wherein the cell expresses a DNMT3A methyltransferase, and wherein the fusion protein recruits DNMT3A to the genomic locus in the cell.

54. The method of any one of Embodiments 46-53, wherein epigenetically modifying the genomic locus comprises methylating DNA at or near the genomic locus.

55. The method of any one of Embodiments 46-54, wherein the genomic locus includes a target gene.

56. The method of any one of Embodiments 46-55, wherein epigenetically modifying the genomic locus decreases or silences expression of the target gene.

57. The method of any one of Embodiments 46-56, wherein expression of the fusion protein is self-silenceable.

58. An epigenetically-modified cell produced by the method of any one of Embodiments 46-57, or a progeny cell thereof.

59. A method of treating a disease in a subject in need thereof, comprising administering to the subject the fusion protein of any one of Embodiments 1-24, the polynucleotide of any one of Embodiments 25-27, the vector of any one of Embodiments 29-31, the gene delivery system of any one of Embodiments 21-26 and 41, the composition of Embodiment 38 or 41, the pharmaceutical composition of Embodiment 39 or 41, or the cell of any one of Embodiments 42-45.

60. The method of Embodiment 59, wherein the disease is genetic disorder (e.g., Angelman syndrome), an infectious disease, or a neurodegenerative disease.

61. The method of Embodiment 59 or 60, wherein the disease is a prion disease.

Exemplification

DNA methylation at cytosine-guanine dinucleotides (CpGs) and post-translational histone modifications are important regulators of heritable transcriptional programs. Epigenetic editors exploit these mechanisms to control gene expression without modifying the underlying DNA sequence. Designer proteins made possible by the CRISPR-associated catalytically inactive dCas9 system are unprecedented in their ability to precisely deposit or remove epigenetic marks at predetermined genomic loci.

A key recent advance is the development of CRISPRoff, a readily programmable epigenetic editor which can heritably silence the large majority of human genes following transient expression in cells in a diverse array of cell types including neurons. CRISPRoff is a single fusion protein consisting of dCas9, a KRAB (Krüppel associated box) domain, and DNMT3A (D3A) and DNMT3L (D3L) de novo DNA methyltransferase domains[1]. The KRAB domain directly binds TRIM28, a ubiquitously expressed scaffold protein which recruits heterochromatin modifiers and results in the deposition of repressive H3K9 trimethylation (H3K9me3). Mitotically heritable silencing by CRISPRoff is dependent on DNA methylation and can be reversed using CRISPRon via targeted demethylation by ten-eleven translocation (TET) enzymes. CRISPRoff repression is maintained throughout differentiation in addition to cell division, as demonstrated by persistent gene silencing in neurons produced from CRISPRoff-silenced stem cells. The remarkable increase in efficacy of CRISPRoff compared to dCas9-KRAB (strong but transient repression) or dCas9-D3A/D3L (weak but heritable repression) highlights the spatiotemporal complexity and multi-domain nature of stable epigenetic silencing[2].

From a therapeutic perspective, programmable gene regulation presents several advantages over genetic engineering, including tunability, reversibility, and lack of DNA break-associated cytotoxicity. Additionally, because epigenetic silencing works by preventing expression of the targeted gene rather than introducing mutations, there is no risk of toxicity from chronic expression of a mutated message which will tax the cell's nonsense-mediated decay machinery by encoding for a damaged, truncated protein. However, two main limitations hinder therapeutic applications of the current CRISPRoff design. First, CRISPRoff requires the overexpression of a potentially toxic DNA methyltransferase domain with the possibility of off-target edits. Second, the CRISPRoff fusion protein is ~6.2 kilobases in length, exceeding the packaging capacity of AAV delivery vectors. There is a need for the development of a more compact and less toxic epigenetic editor to overcome these challenges.

Example 1. Recruitment of Endogenous DNMT3A Methyltransferase

In a cell, DNA methylation by DNMT3A is tightly controlled through autoinhibition of its methyltransferase domain by its ATRX-DNMT3-DNMT3L (ADD) domain. This autoinhibitory conformation is only released upon binding of the ADD domain to unmethylated histone domain 3 lysine 4 (H3K4me0), an epigenetic mark absents from active promoters[3]. See, e.g., the top panel of FIG. 3*i* in Lue et al., Nat Chem Bio (2022), where a cartoon depicts DNMT3A2 changing to its active conformation upon binding of the ATRX-DNMT3-DNMT3L (ADD) domain to H3K4me0. Purified DNMT3A2 (SEQ ID NO:29), the predominant isoform of DNMT3A in embryonic stem cells, was indeed stimulated by a 12 amino acid H3K4me0 peptide (SEQ ID NO:81) in an in vitro assay measuring tritium-labeled DNA methylation activity[4]. See, e.g., FIG. 2*g* in Lue et al., Nat Chem Bio (2022).

DNMT3L, the cofactor required for DNMT3A stabilization in the cell, is known to associate with DNMT3A via contacts in their respective C-terminal domains[5]. Taking advantage of this, a new strategy was developed for DNA methylation-mediated epigenetic silencing analogous but distinct to CRISPRoff by leveraging the use of the endogenous DNMT3A methyltransferase. Rather than overexpressing the methyltransferase domain as a fusion protein, it was instead recruited to the target site through interactions with the DNMT3L C-terminal domain and the unmethylated H3 tail fused to the N-terminus of the editor. Using a fluorescent reporter assay developed to assess promoter silencing of the endogenous CLTA gene in HEK293T cells (BioRender, Toronto, Canada, FIG. 1A), several epigenetic editors, including the canonical CRISPRoff and CRISPRi constructs, were systematically compared (FIG. 1B). The CLTA sgRNA sequence used in these experiments was GCUCCCAGUCGGCACCACAG (SEQ ID NO:401).

By tracking silencing of the reporter over time, robust stimulation of activity by the histone tail and DNMT3L alone was observed. Silencing activity was abolished when the H3 lysine 4 is mutated to alanine (FIG. 2A). Heritable silencing was measured up to 18 days post-transfection, similar to CRISPRoff, whereas CRISPRi silencing was transient (FIG. 2B).

Figure 3A:
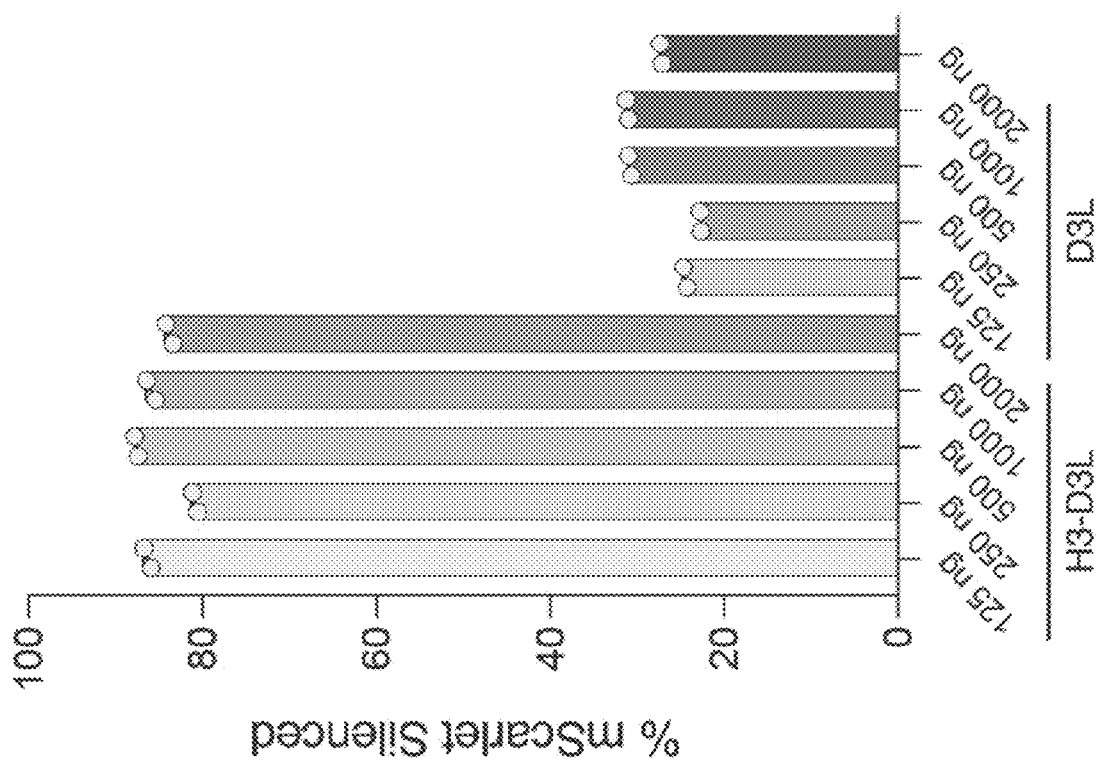

To verify that this effect was due to the mechanism of histone tail binding rather than simply stabilizing or altering expression of the fusion protein, a dose titration comparing DNMT3L with or without the histone H3 tail was performed. At 18 days post-transfection, there was little difference in silencing activity across transfected DNA concentrations, indicating that the epi-editor was unlikely to be dose-limited (FIG. 3A). Likewise, by gating for different levels of expression while sorting the transfected cells, there appeared to be no improvement in silencing efficacy by day 16 post-transfection (FIG. 3B). This indicates that activity of the epi-editor was not limited by translation and stability of the fusion protein.

Example 2. Epi-Editor Optimization

Figure 4A:
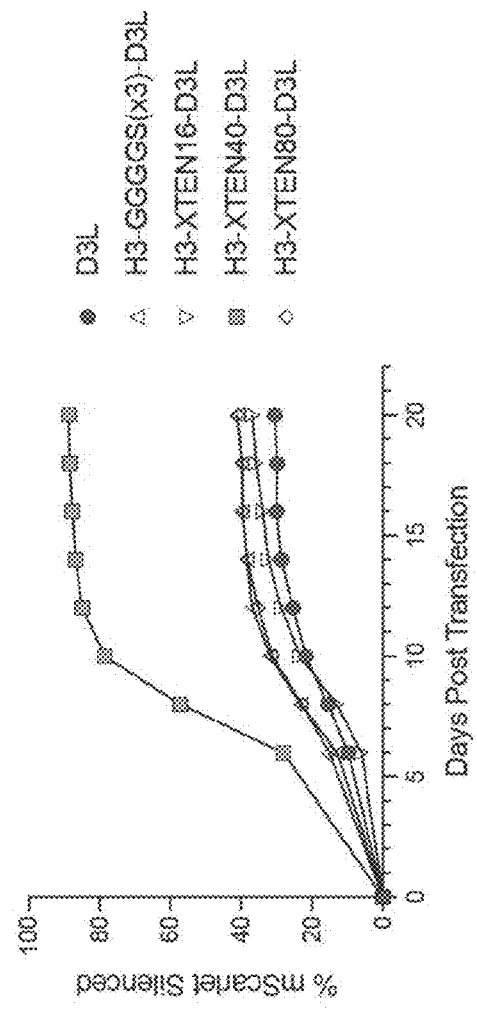
FIGS. 4A-4C Optimization of linkers.
Figure 4B:
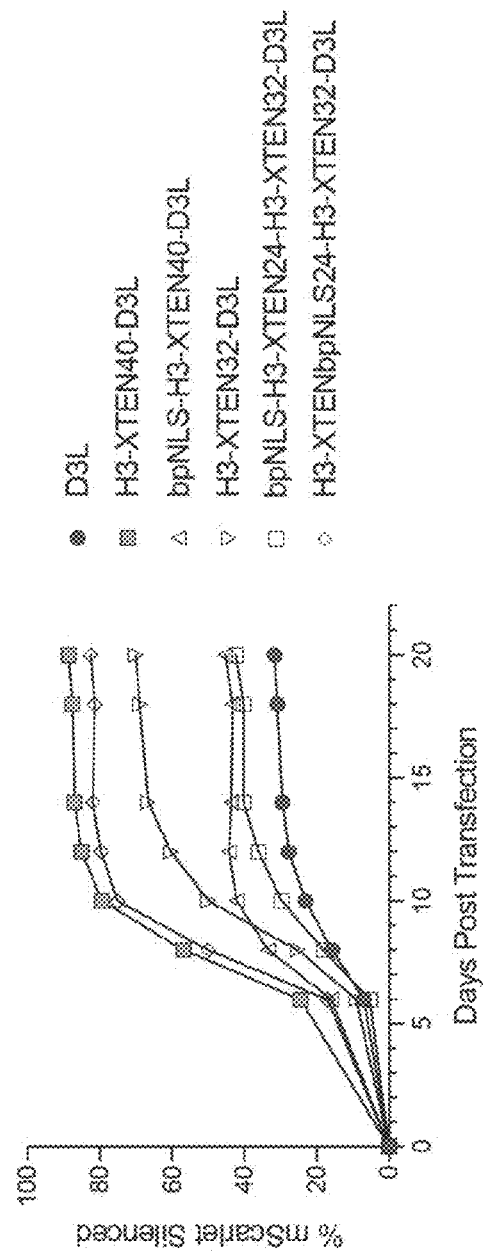
Figure 4C:
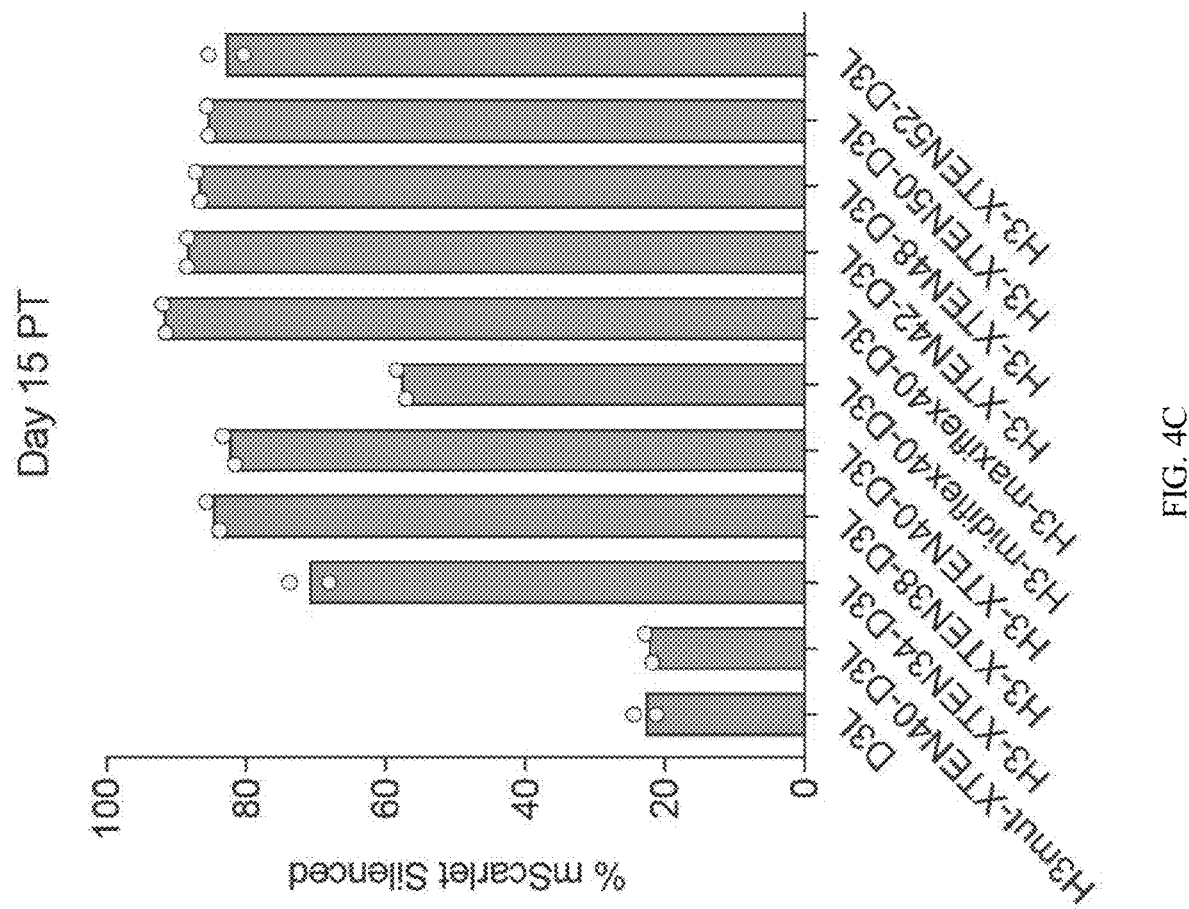

The activity of the H3 tail fusion to Dnmt3l is largely dictated by the linker connecting the two domains. The linker length is sensitive to changes, and the first active fusion determined was with the XTEN40 linker (FIG. 4A). All experiments up to this point used the XTEN40 linker. Next, due to the 2:2 stoichiometry of the natural DNMT3L-DNMT3A2 complex in cells[5], it was hypothesized that a fusion containing two H3 tail peptides could have improved affinity for DNMT3A and faster silencing kinetics. On the contrary, these fusions had worse activity than the single H3 tail fusion. Similarly, adding an N-terminal NLS to the fusion also inhibited activity. These observations suggest that the H3 tail peptide requires a free N-terminus for full DNMT3A recruitment and silencing activity (FIG. 4B). To optimize the epi-editor further, linker lengths were tiled around the 40-amino acid length to fine-tune the activity. Additionally, XTEN40 linkers mutated to become more flexible (by removing prolines and adding additional glycines), hereby termed "midiflex" or "maxiflex," were also assessed. The most active construct used the 40-amino acid maxiflex linker, which was selected for future tests (FIG. 4C).

Figure 5A:
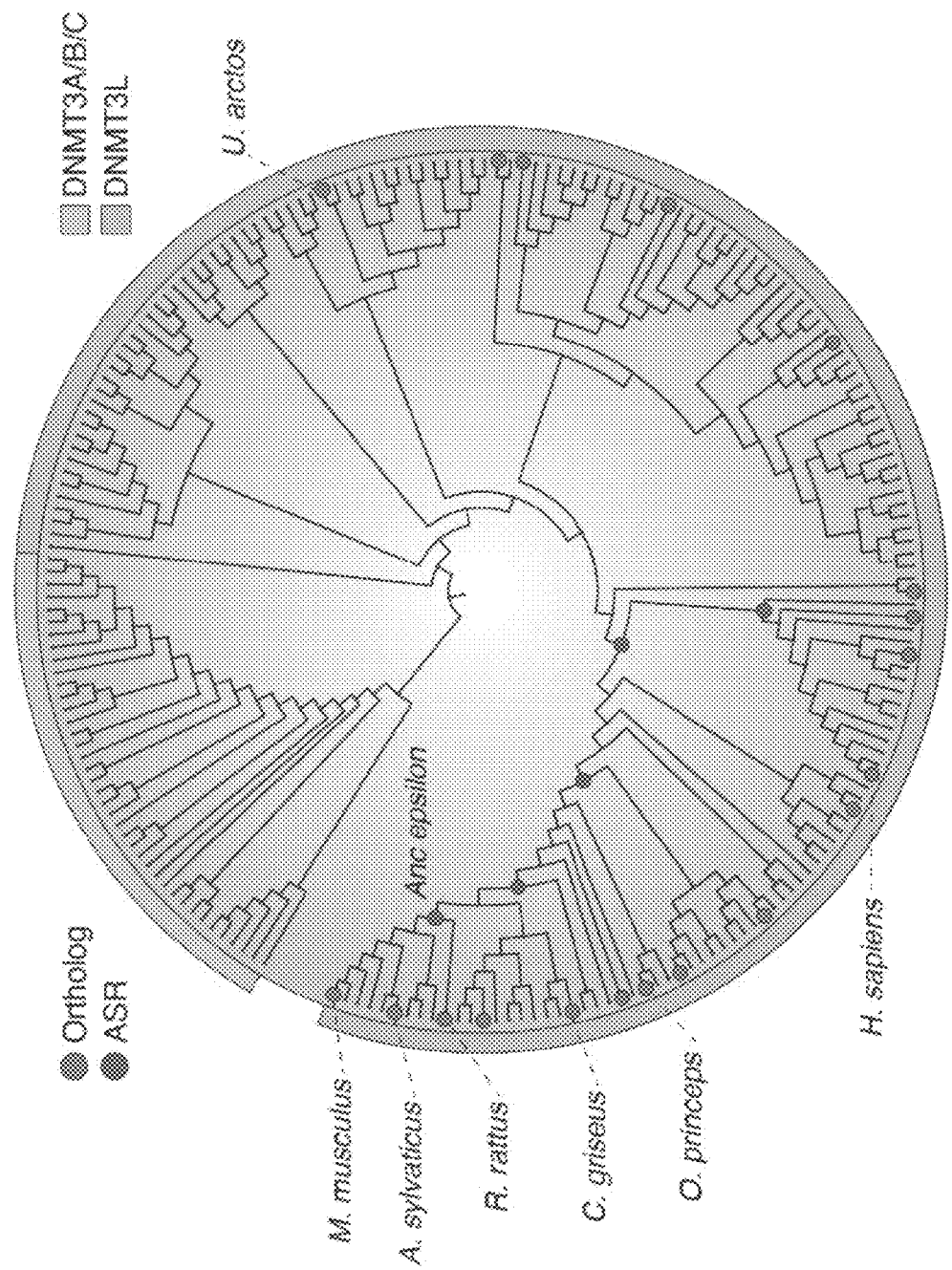
FIGS. 5A-5B Genome mining for improved DNMT3L.
Figure 5B:
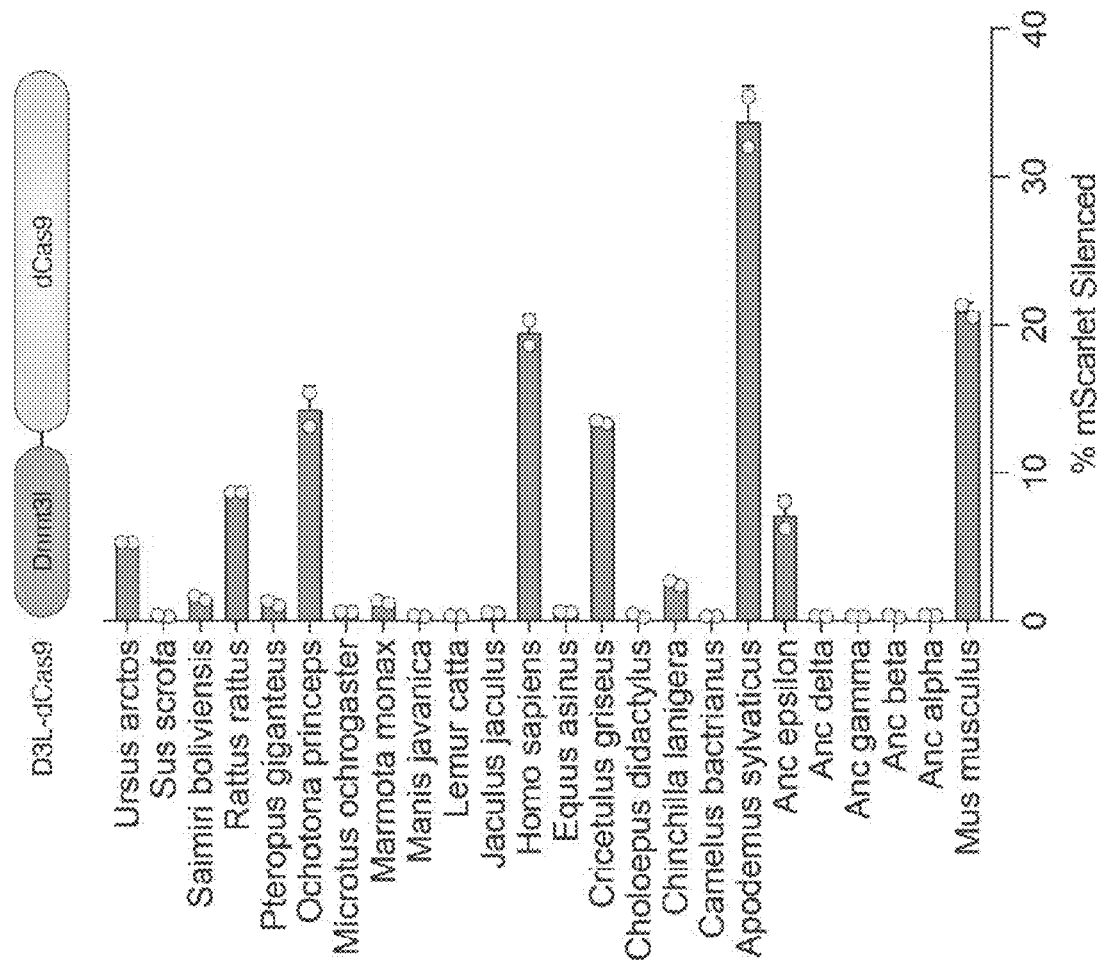

The next effort to engineer an improved epigenetic editor targeted the Dnmt3l component of the fusion protein. The C-terminal domain of mouse (*Mus musculus*) Dnmt3l was used for historical reasons by building on previous work[1,2]. Rather than performing random mutagenesis and selecting an improved MmDnmt3l from a mutant library, the much smaller sequence space of existing Dnmt3l orthologs was searched. Orthologous genes are most likely to fold properly and function in their native host species, whereas random mutants will most often be defunct. Following published strategies for genome mining and ancestral reconstruction[6], 19 orthologs and 5 ancestral nodes were selected for synthesis with a bias for Dnmt3l C-terminal domains with closer phylogenetic relationships to the mouse or human proteins (FIG. 5A). These were then screened using the mScarlet-CLTA reporter system to compare activity against the original MmDnmt3l C-terminal domain. Only one ortholog, *Apodemus sylvaticus* or European wood mouse, performed better during the reporter silencing time course (FIG. 5B).

Zinc finger proteins (ZFPs) are one of the most common types of DNA-binding proteins in eukaryotes. They consist of an array of finger-like protrusions making contacts with nucleotide bases in the major groove of the DNA double helix and are typically stabilized by zinc ions[7]. Each finger motif interacts with a specific nucleotide triplet, so a 6-finger ZFP, for example, can target an 18-bp site of the genome with a high degree of specificity. A successful method for engineering new ZFPs is the modular assembly of pre-characterized fingers to target nucleotide triplets in a custom order such that any sequence can be targeted[8]. ZFPs offer several advantages as a therapeutically relevant DNA targeting module: first, their compact size, roughly an order of magnitude smaller than that of SpCas9, makes them suitable for delivery via an AAV vector; next, they are not required to complex with an RNA guide as is the case with CRISPR systems, meaning they are active as soon as they are translated and can access compartments such as the mitochondria; and finally, ZFPs are less immunogenic due to their lack of bacterial epitopes[9].

In contrast to Cas9, which intercalates into the DNA, zinc fingers bind directly to double-stranded DNA while causing minimal distortion to the double helix. DNA methyltransferases act directly on double-stranded DNA and methylation-based silencing is compatible with both Cas9 and ZFPs.

Previous work has motivated the interest in using ZFPs in effector constructs for targeted and heritable gene silencing. Engineered ZFPs fused to a KRAB domain was shown therapeutic efficacy in transcriptional repression of the pathologic mutant huntington gene in three Huntington's disease mouse models[10], the tau gene MAPT in the Alzheimer's disease APP/PS1 mouse model[11], and the NaV1.7 sodium ion channel in the lumbar dorsal root ganglia of three mouse models for hyperalgesia via intrathecal AAV-mediated delivery[12]. Additionally, a ZFP fused to the VP64 transcriptional activator domain has been shown to upregulate SCN1A, a sodium ion channel subunit, in GABAergic inhibitory neurons to correct Dravet syndrome via single bilateral intracerebroventricular AAV-mediated delivery in a Scn1a$^{+/-}$ mouse model[13]. This intervention was well tolerated in non-human primates.

Figure 6:
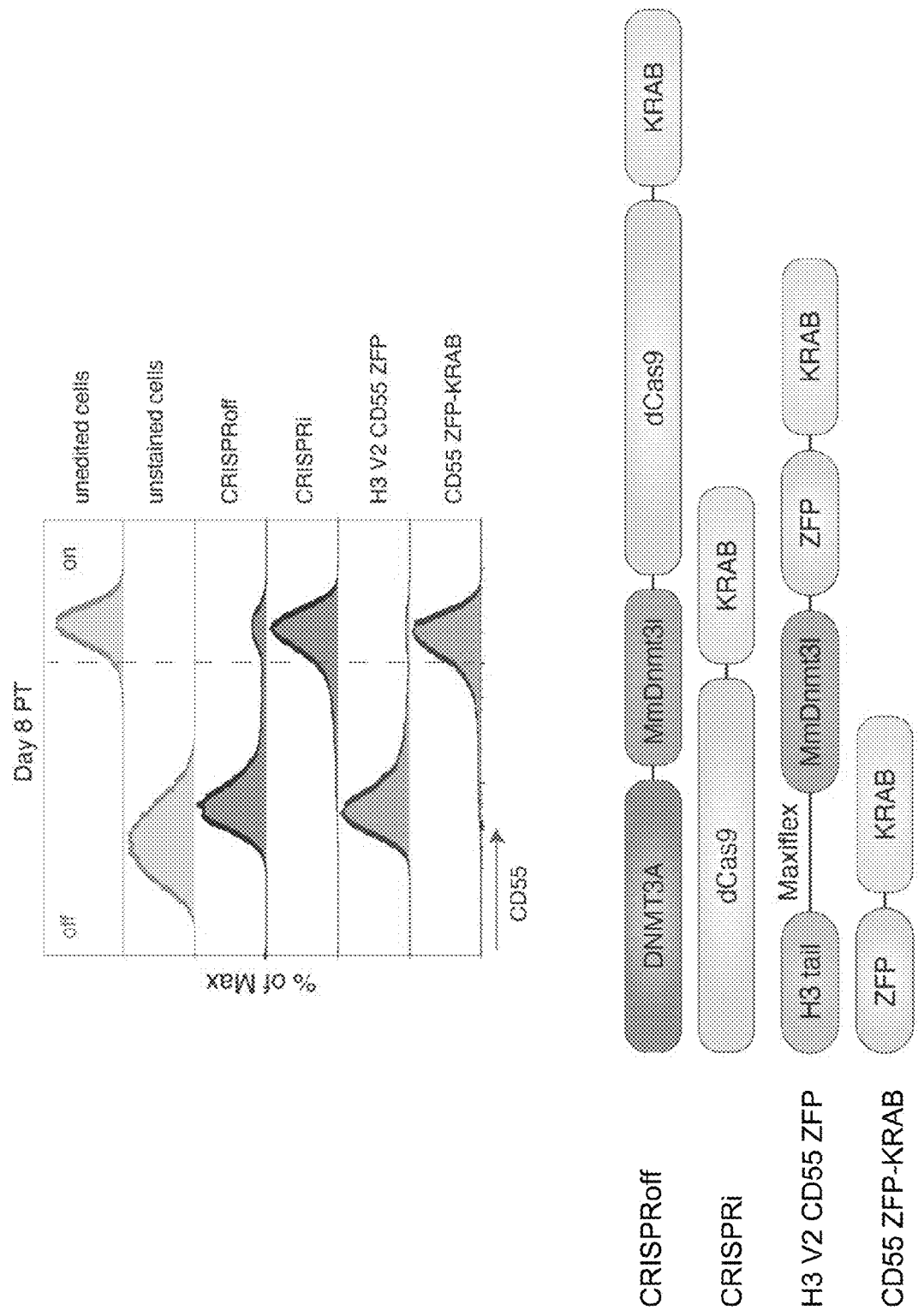
FIG. 6 H3-D3L-ZFP-KRAB is comparable to CRISPRoff. Percent CD55 cell surface marker (stained with APC conjugate antibody) silencing at day 6 post-transfection. D3L, Dnmt3l C-terminal domain. H3, H3K4me0.
Figure 7:
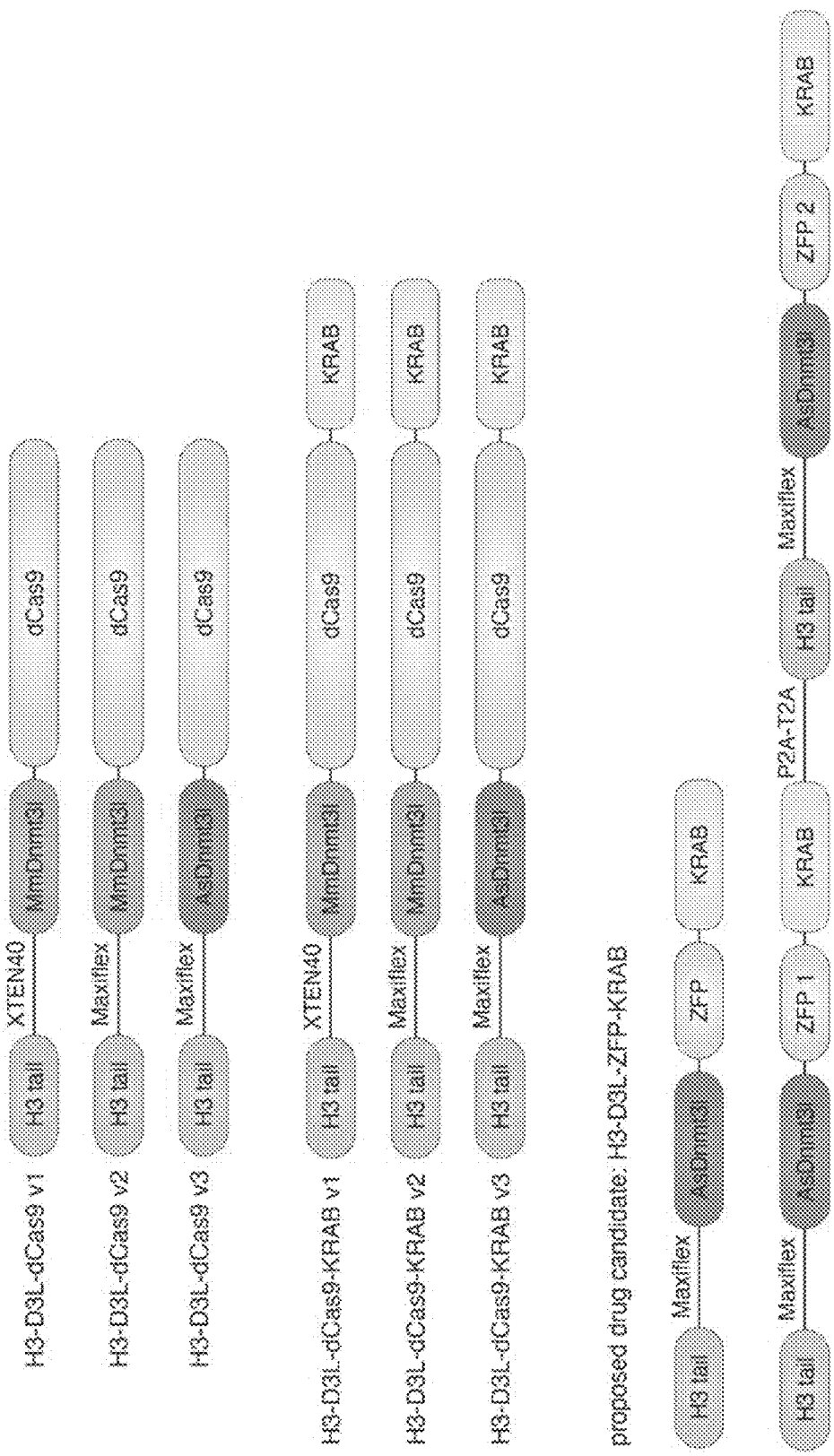
FIG. 7 Non-limiting examples of H3 epi-editors. Schematics of histone tail-based epigenetic editors through multiple rounds of optimization. Drug candidates are designed to be less than the AAV vector packaging limit of 4.7 kilobases of DNA. D3L, Dnmt3l C-terminal domain. H3, H3K4me0. Mm, *Mus musculus*. As, *Apodemus sylvaticus*.

Using a ZFP targeting the human CD55 gene promoter, which was a gift from Fyodor Urnov of UC-Berkeley, a ZFP-targeted version of the H3 tail epigenetic editor was generated (FIG. 7). H3-ZFP effectively silenced CD55 in HEK293T cells, comparably to CRISPRoff, while the KRAB domain alone did not achieve the same level of silencing (FIG. 6).

Since the histone tail-based epigenetic editor has gone through several rounds of optimization, various iterations version numbers were assigned (FIG. 7). Two ZFP-based editors have the potential to be packaged into a single AAV particle for in vivo delivery to target tissues, such as the central nervous system, due to their small sizes. One such construct is being developed to silence the PRNP gene (prion protein) in the brain to treat and prevent prion diseases.

At roughly 5% the length of the catalytic domain of DNMT3A, the histone H3 tail fusion offers a step toward a more compact epi-editor suitable for AAV delivery, reduced off-target edits (by avoiding overexpression of the methyltransferase domain), i.e., a smaller, safer, and more effective gene silencing modality than CRISPRoff.

Figure 8A:
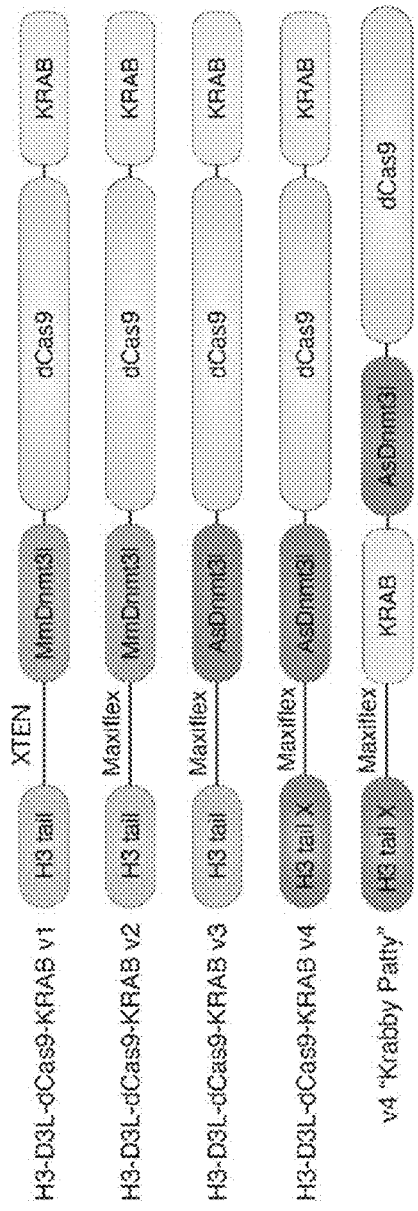
FIGS. 8A-8B Non-limiting examples of H3 epi-editors.
Figure 8B:
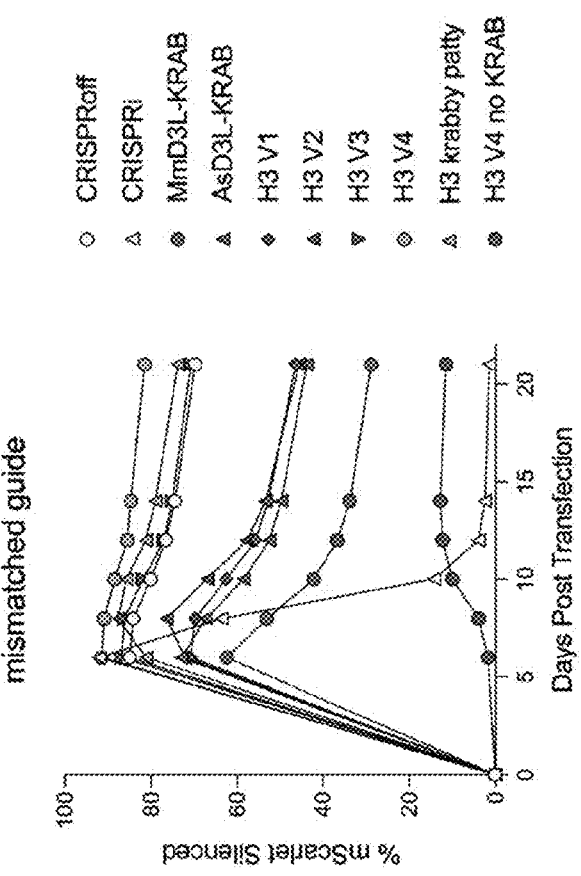

The original histone-tail based epigenetic silencers underwent several rounds of optimization leading to the most current version, H3V4. These included changes to the histone tail length, the linker sequence, the Dnmt3l ortholog, and the KRAB domain positioning (FIG. 8A). The CLTA reporter locus was transiently targeted with dCas9 and sgRNA as illustrated in FIG. 1A, except for a mismatched sgRNA, GCUCCGAGUCGGCACCACAG (SEQ ID NO:402), was used to increase the dynamic range of the analysis. Without being bound by theory, introducing one or more mismatches in a sgRNA sequence reduces silencing of a target DNA (via DNA methylation and heterochromatin formation) by increasing the rate of sgRNA dissociating from the target DNA ("off rate"). H3V4 and a version denoted "Krabby Patty" outperformed canonical CRISPRoff in long-term gene repression (FIG. 8B). H3 tail X denotes an H3 tail comprised of the first 30 amino acids of the histone H3 protein, whereas previous versions only used the first 12 amino acids. Furthermore, in "Krabby Patty," the KRAB domain was incorporated into the linker between the H3 tail and the D3L domain; this allows for more flexibility in transgene design. For example, by keeping all functional domains at the N-terminal side of the DNA-binding domain, split-inteins can be used to allow efficient packaging of multiple DNA-binding domains (like zinc finger proteins) for compact, multiplexed targeting.

Example 3. In Vivo Silencing in the Central Nervous System (CNS)

Epigenetic transcriptional silencing based on DNA methylation (DNAme) at cytosine-guanine dinucleotide (CpG) sites within promoter regions is durable through cell division and differentiation, however, existing technologies rely on overexpression of the DNA methyltransferase DNMT3A catalytic domain[1-2, 14]. This can result in cytotoxicity and off-target methylation, which limits its utility as a therapeutic. Moreover, the large size of the transgene precludes its delivery by adeno-associated virus vectors, which have a packaging capacity around 5 kb and are the current state-of-the-art for gene therapy[15]. Therefore, the small, non-toxic histone-tail based editor disclosed herein is the first epigenetic editing tool capable of establishing DNA methylation and silencing of target genes in the central nervous system mediated by AAV delivery.

This engineered epigenetic silencer was used to turn off Prnp gene transcription in mouse brains in vivo by AAV-mediated delivery. Because prion diseases, such as Creutzfeldt-Jakob disease, fatal familial insomnia, kuru, and Gerstmann-Straussler-Scheinker disease, are currently untreatable and always fatal, this novel gene therapy could have an outsize impact on the prognosis for patients with these devastating neurological disorders[16].

Figure 9:
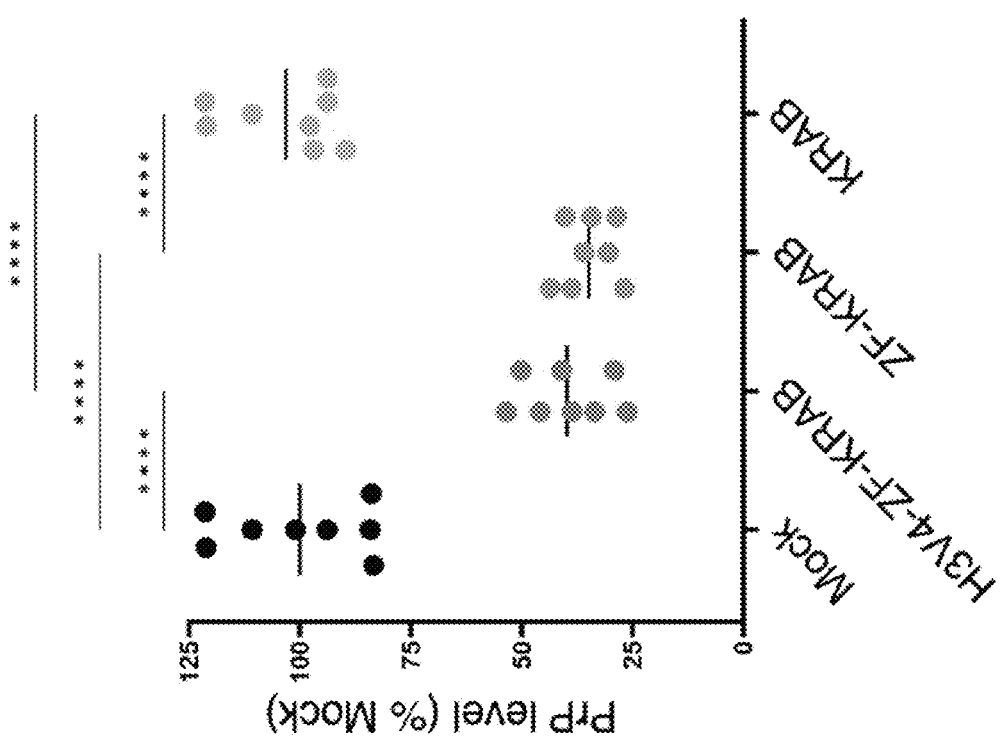
FIG. 9 In vivo knockdown of PrP. ELISA of prion protein from right hemisphere brain homogenate taken from mice six weeks after AAV injection with each indicated transgene. Data are mean±SD of n=8 replicates.

Three transgenes were tested: the histone tail editor (H3V4) fused to a Prnp-targeting zinc finger protein (ZFP), ZFP-KRAB, and KRAB only, with no DNA-binding domain. These were packaged into AAV-PHP.eB capsids[15] and retro-orbitally injected into C57BL/6N mice (n=8) at a dosage of 1.5e13 virus genomes per kilogram (vg/kg) along with a mock buffer control. The mice were sacrificed six weeks after treatment, and we were able to see up to 75% prion protein (PrP) repression in bulk brain homogenate as measured by ELISA for the H3V4 and ZFP-KRAB conditions, but no repression in controls (FIG. 9).

Figure 10:
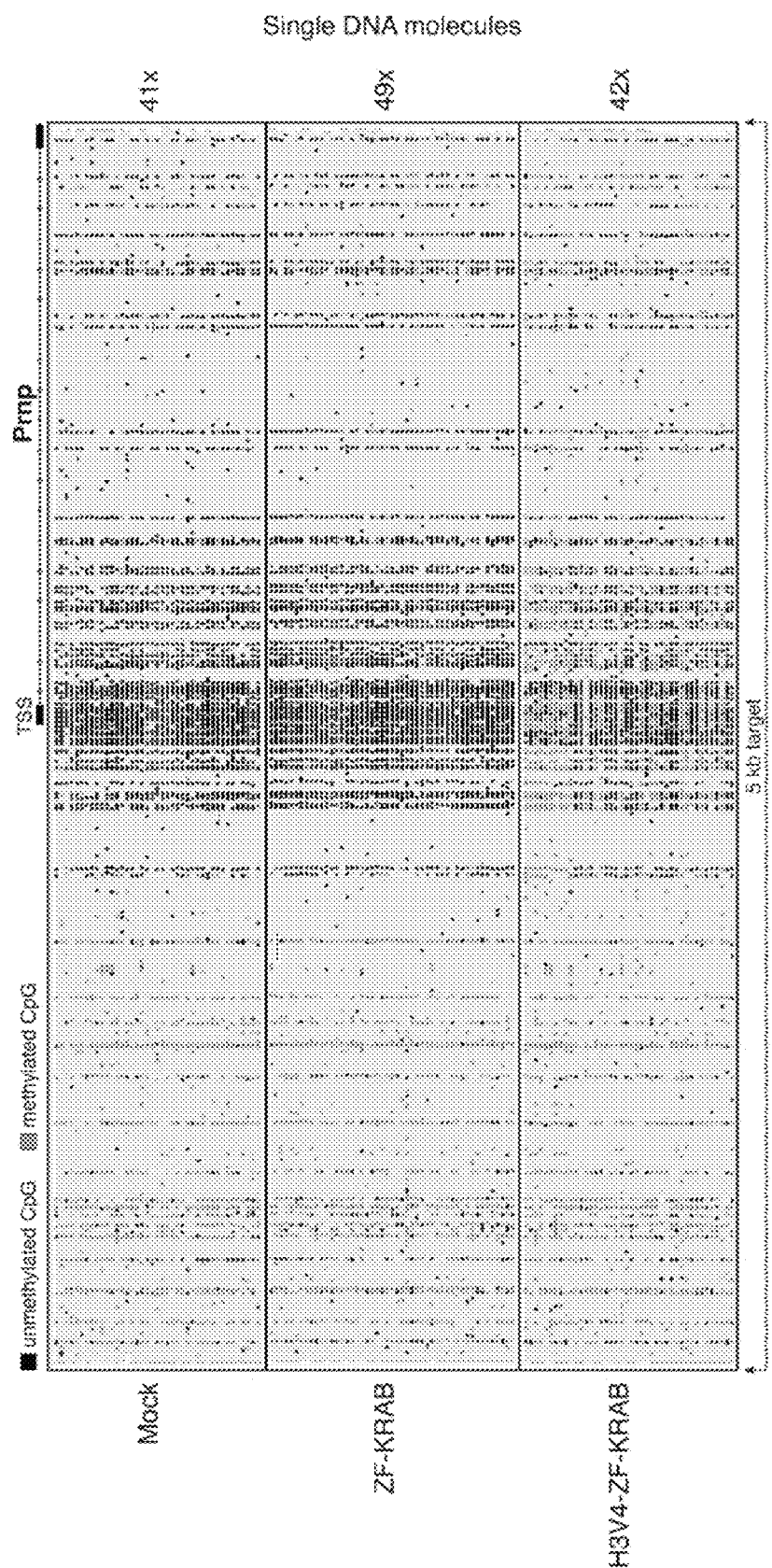
FIG. 10 In vivo methylation of Prnp promoter. Nanopore long-read sequencing of native DNA extracted from coronal sections of mouse left brain hemispheres six weeks after treatment. Each row represents a single molecule from an independent cell covering a 5 kilobase region surrounding the Prnp transcription start site (TSS).

The key distinction between H3V4 and ZFP-KRAB is the DNA methylation activity, so we measured Prnp promoter methylation by long-read Nanopore sequencing of native DNA extracted from coronal sections of the treated mouse brains following established methods[17,18] (FIG. 10).

Figure 11:
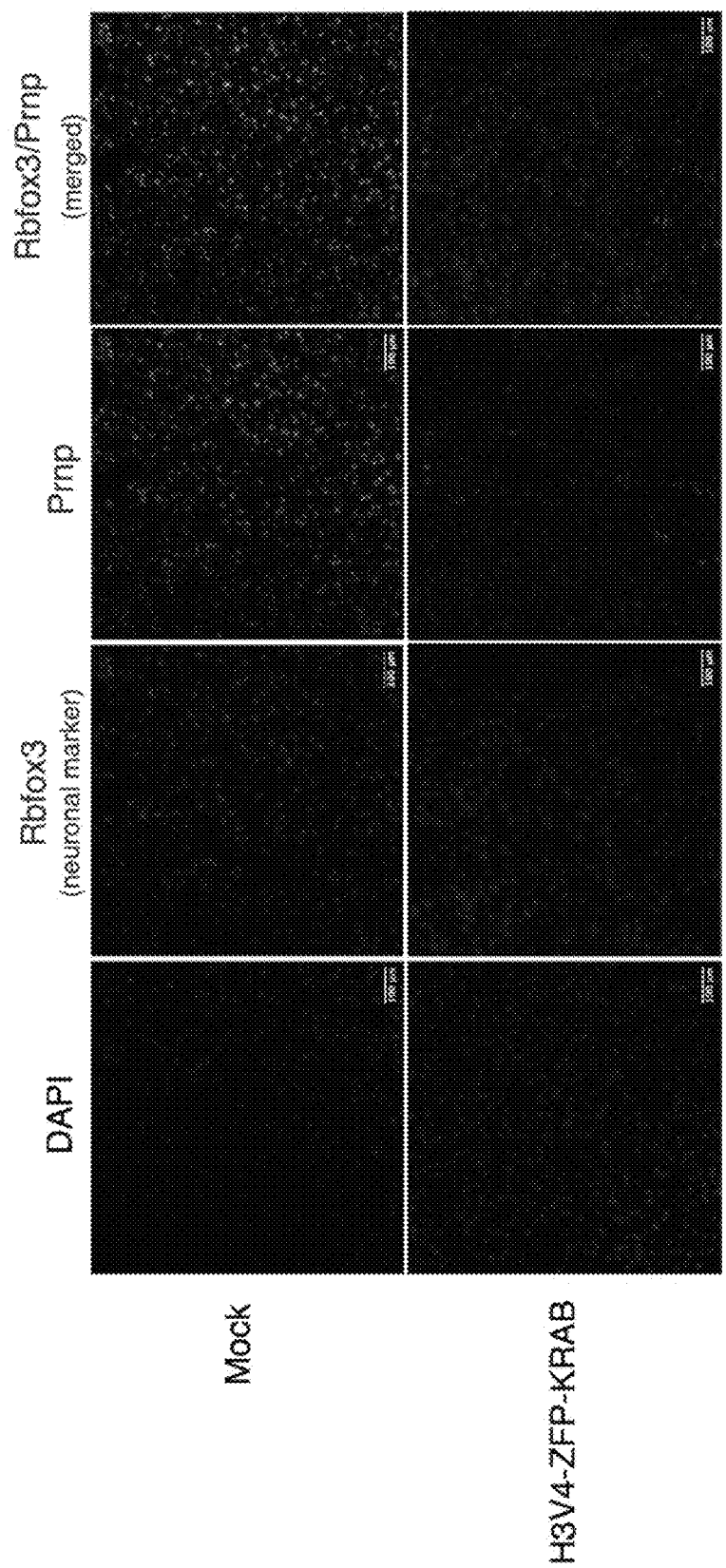
FIG. 11 Knockdown of Prnp transcripts in neurons by HCR-FISH. Coronal brain sections 100 μm thick were used for HCR-FISH against Rbfox3 (neuron-specific) and Prnp transcripts simultaneously for both mock treated mice (top) and mice treated with H3V4-ZFP-KRAB AAVs (bottom). DAPI is a nuclear marker. Scale bars are 100 μm.

To visualize PrP knockdown specifically in neurons, HCR-FISH was used to identify neuronal cell-type specific transcript and Prnp transcripts simultaneously. In short, dissected brain hemispheres were embedded in OCT and frozen on dry ice. Tissues were sectioned coronally on a Cryostat (Leica) to a thickness of 10 μm and mounted on slides. Sections were fixed in 4% PFA for 15 min at 4° C. and incubated successively for 5 min in 50%, 70%, and 100% ethanol at room temperature. Sections were washed in 1×PBS, prehybridized in probe hybridization buffer (Molecular Instruments, Los Angeles, CA) for 10 min at 37° C. and incubated under a coverslip in probe solution in a humidified chamber at 37° C. overnight. Split-initiator probes (Molecular Instruments) targeting Rbfox3 (neuronal marker) and Prnp mRNA were used at a final concentration of 4 nM. Coverslips were floated off in probe wash buffer (Molecular Instruments), and excess probes were removed with successive washes at 37° C. for 15 min in buffers with probe wash buffer: 5×SSCT ratios of 3:1, 1:1, 1:3, and 0:1. Slides were immersed in 5×SSCT at room temperature and equilibrated in amplification buffer (Molecular Instruments) in a humidified chamber for 30 min at room temperature. During this incubation, fluorescent hairpin amplifiers were heated to 95° C. for 90 seconds and snap cooled for 30 min at room temperature. Hairpins were diluted in amplification buffer and added to tissue sections. Sections were coverslipped and incubated overnight at room temperature in a dark humidified chamber. Following four washes in 5×SSCT, sections were mounted with VECTASHIELD Antifade Mounting Medium with DAPI and coverslipped for confocal imaging on the Zeiss LSM 710 confocal laser scanning microscope. As shown in FIG. 11, Prnp transcripts were strongly reduced in neurons.

Example 4. Self-Silencing

Epigenetic editing leads to permanent repression of targeted genes following transient expression of an epigenetic editor (epi-editor). This presents a significant therapeutic advantage, as it eliminates the need for repeated dosing or continuous expression of a potentially toxic or immunogenic fusion protein. However, continuous expression of an epi-editor may be unavoidable for certain delivery methods, such as adeno-associated virus (AAV)-mediated delivery to non-dividing cells.

A self-silencing epi-editor, that effectively merges the benefits of AAV gene delivery with those of epigenetic silencing, has been developed. The epi-editor was designed to silence itself after silencing its target, ensuring short-lived expression regardless of delivery mechanism. To achieve this, the DNA binding sequence of the epi-editor's DNA-binding domain was incorporated to the promoter region driving epi-editor expression.

Figure 12A:
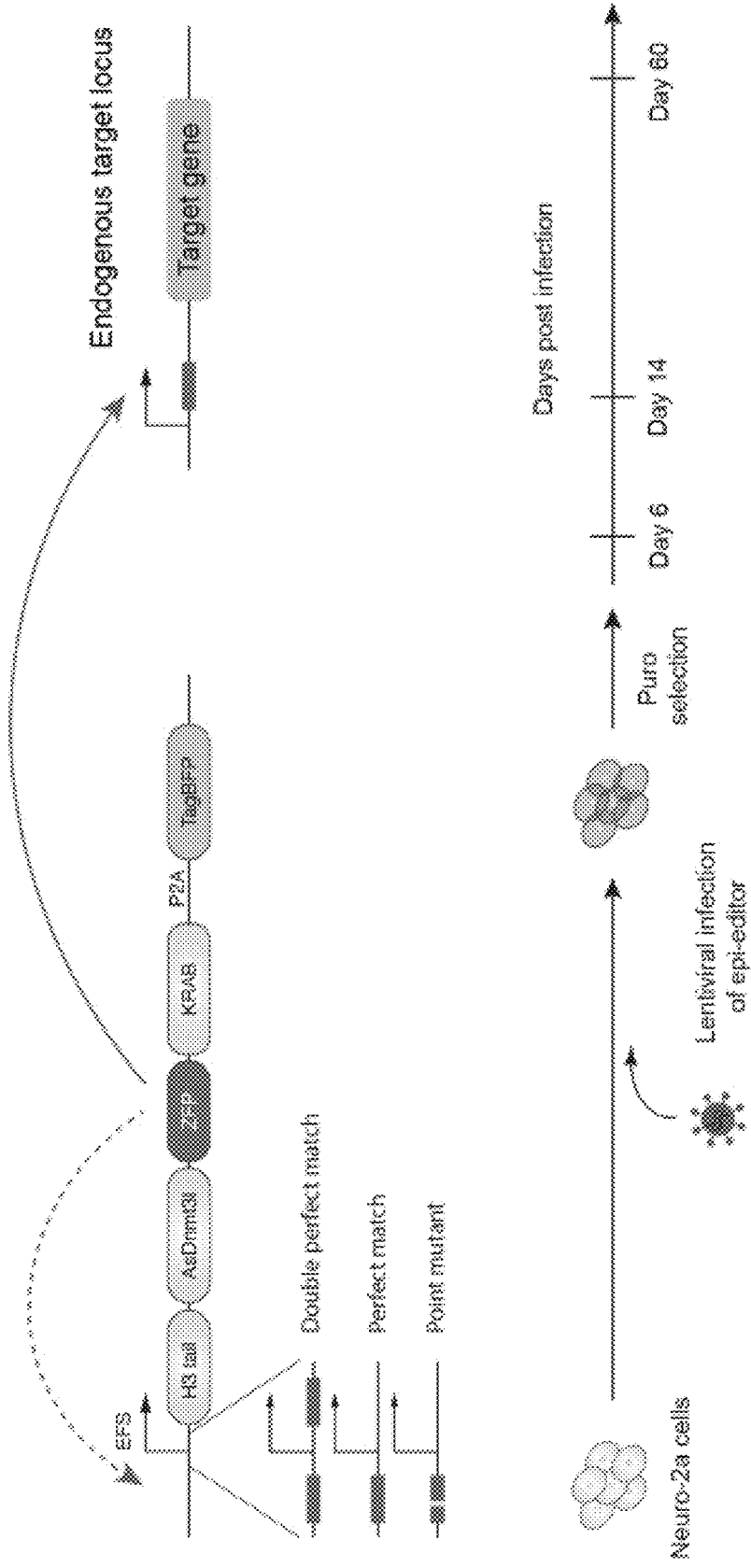
FIGS. 12A-12B A non-limiting example of a self-silencing epi-editor.

An experiment using self-silencing lentiviral vectors was conducted in mouse Neuro-2a cells (FIG. 12A). The epi-editor comprised an unmethylated H3 tail, a DNMT3L C-terminal domain, a zinc finger DNA-binding domain, and a Krüppel-associated box (KRAB) domain. Multiple binding site configurations were assessed to achieve optimal self-silencing kinetics (i.e., the epi-editor was expressed long enough to establish permanent silencing of the target gene). The following versions were tested: (1) dual self-silencing binding sites flanking the promoter, (2) a single self-silencing binding site located upstream of the promoter (SEQ ID NO:403), and (3) an upstream binding site with a point mutation (SEQ ID NO:406) (FIG. 12A).

TABLE 1

Self-silencing zinc finger binding sites (Using ZFP mouse Prnp 2)

|    | F6  | F5  | F4  | F3  |   | F2  | F1  |    |
|----|-----|-----|-----|-----|---|-----|-----|----|
| GC | CCA | GAA | TCG | GTC | T | GCT | GAT | CC |
| GC | CTA | GAA | TCG | GTC | T | GCT | GAT | CC |
| GC | CCA | GGA | TCG | GTC | T | GCT | GAT | CC |
| GC | CCA | CAA | TCG | GTC | T | GCT | GAT | CC |
| GC | CCA | GAA | TTG | GTC | T | GCT | GAT | CC |
| GC | CCA | GAA | TCG | GCC | T | GCT | GAT | CC |
| GC | CCA | GAA | TCG | CTC | T | GCT | GAT | CC |
| GC | CCA | GAA | TCG | GTC | T | GTT | GAT | CC |
| GC | CCA | GAA | TCG | GTC | T | CCT | GAT | CC |
| GC | CCA | GAA | TCG | GTC | T | GCT | GGT | CC |
| GC | CCA | GAA | TCG | GTC | T | GCT | CAT | CC |
| GC | CCA | CAA | TCG | GTC | T | GCT | CAT | CC |
| GC | CCA | CAA | TCG | CTC | T | GCT | CAT | CC |
| GC | AGC | AGC | GTT | CCG | T | AGC | TTA | CC |

Sequences corresponding to those in the Table 1 are:

(SEQ ID NO: 403)
GCCCAGAATCGGTCTGCTGATCC.

(SEQ ID NO: 404)
GCCTAGAATCGGTCTGCTGATCC.

(SEQ ID NO: 405)
GCCCAGGATCGGTCTGCTGATCC.

(SEQ ID NO: 406)
GCCCACAATCGGTCTGCTGATCC.

(SEQ ID NO: 407)
GCCCAGAATTGGTCTGCTGATCC.

(SEQ ID NO: 408)
GCCCAGAATCGGCCTGCTGATCC.

(SEQ ID NO: 409)
GCCCAGAATCGCTCTGCTGATCC.

(SEQ ID NO: 410)
GCCCAGAATCGGTCTGTTGATCC.

(SEQ ID NO: 411)
GCCCAGAATCGGTCTCCTGATCC.

(SEQ ID NO: 412)
GCCCAGAATCGGTCTGCTGGTCC.

(SEQ ID NO: 413)
GCCCAGAATCGGTCTGCTCATCC.

(SEQ ID NO: 414)
GCCCACAATCGGTCTGCTCATCC.

(SEQ ID NO: 415)
GCCCACAATCGCTCTGCTCATCC.

(SEQ ID NO: 416)
GCAGCAGCGTTCCGTAGCTTACC.

Other than SEQ ID NO:406, promoters comprising an upstream binding site with 1-3 mutations (comprising SEQ ID NO:404, SEQ ID NO:405, or one of SEQ ID NOs:407-415), were also tested, and varying rates of self-silencing were observed. A promoter comprising an upstream binding site comprising SEQ ID NO:416, a scrambled binding site, was used as a negative control.

Figure 12B:
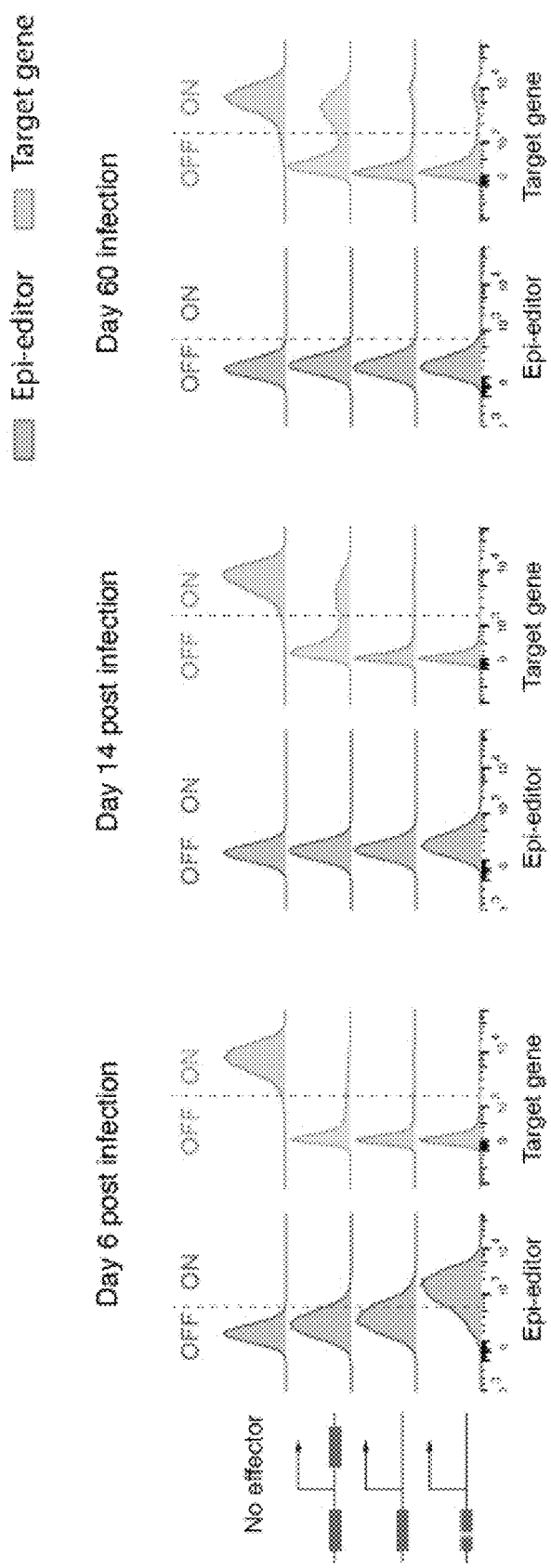

In all instances, robust initial silencing of the target gene was observed, followed by silencing of the epi-editor (FIG. 12B). With the exception of the dual binding site vector which self-silenced too fast, minimal reactivation of either the target gene or the epi-editor was observed 60 days post transduction (FIG. 12B).

Example 5. Split-Intein Effectors

Figure 13:
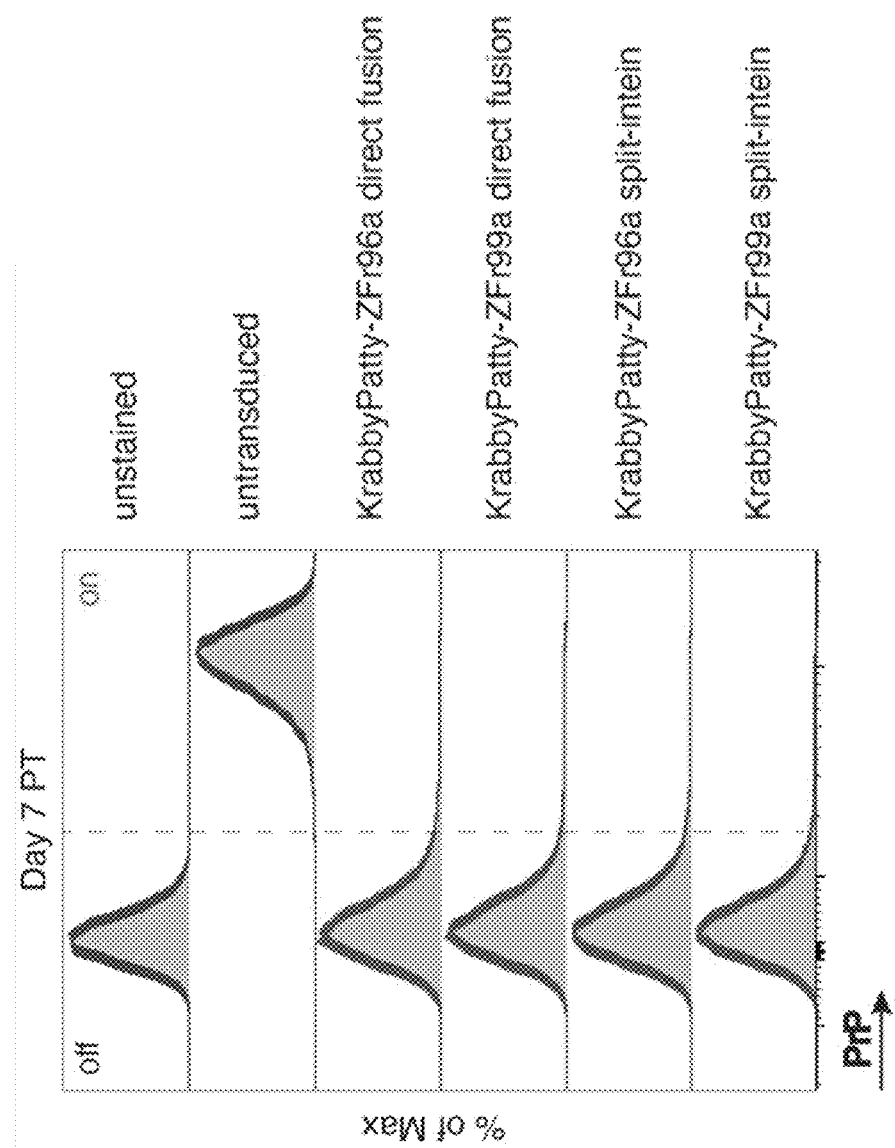
FIG. 13 Split-intein effectors function well in HEK293 Ts. HEK cells transduced with lentiviruses packaging direct fusions of H3V4 Krabby Patty effector and ZFP targeting the HsPRNP gene promoter were just as effective at silencing the target as effectors separated from the ZFP by a T2A-P2A sequence. Histograms represent flow cytometry measurement of cells stained with APC-conjugated PrP antibodies (BioLegend antibody 6D11). ZFPs r96a and r99a were custom designed and purchased from Sigma Aldrich's zinc finger design pipeline (licensed from Sangamo Therapeutics). Method was the same as FIG. 12A but with HEK293T cells instead of N2a cells.

The advantage of compact epi-editors was further demonstrated by showing that the effector domain can be separated from the DNA-binding domain by split Npu inteins[19,20]. Lentivirus packaged with a cassette driving expression of the H3V4 Krabby Patty effector followed by two consecutive 2A ribosome skipping sequences upstream of the ZFP was equally as effective at silencing PRNP in HEK293T cells as a direct fusion between the effector and ZFP (FIG. 13).

Figure 14:
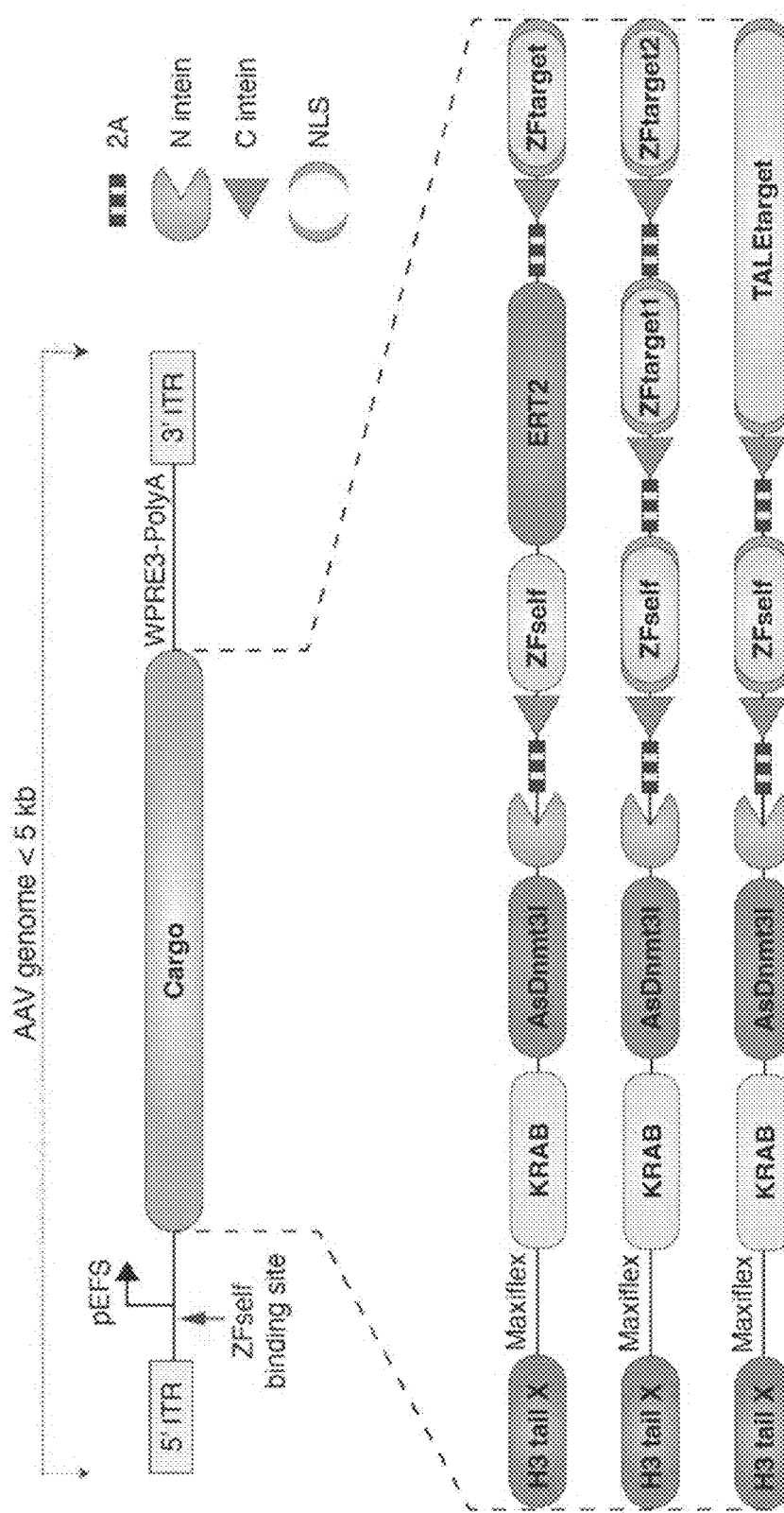
FIG. 14 Schematics of split-intein based multiplexing strategies in AAV vectors. Multiple DNA-binding domains can be multiplexed with a single effector using a split-intein strategy. The ERT2 engineered estrogen receptor domain has been used for synthetic biology applications requiring drug-controllable nuclear accumulation[21]. Self-binding ZFPs can be combined with target-binding ZFPs to allow for the AAV to turn off its transgene cassette after the target gene is silenced.

Likewise, this strategy can lend itself to multiplexing of the effector with multiple different DNA-binding domains within the confined cargo capacity of an AAV vector (FIG. 14). Other DNA-binding domains including transcription activator-like effectors (TALEs) can also fit within an AAV and provide an alternative DNA targeting modality.

Example 6. AAV-Mediated Silencing of Prion Protein by a Compact Epigenetic Editor Prion diseases are caused by misfolding of the endogenous prion protein, PRNP, setting off a chain reaction of templated misfolding to form toxic aggregates that cause neuronal death[16]. PRNP misfolding can occur spontaneously, the likelihood of which is increased by certain inherited mutations, or as the result of infection with misfolded prion seeds[16,22]. Several prion diseases have been documented, including Creutzfeldt-Jakob disease (CJD), fatal familial insomnia (FFI), Kuru, and Gerstmann-Straussler-Scheinker (GSS) disease in humans as well as scrapie, chronic wasting disease, and bovine spongiform encephalopathy (or mad cow disease) in animals[16]. Despite the rarity of these diseases[23], a deep molecular understanding of their etiology provides a path toward potential treatment and prevention[22]. Mice lacking the Prnp gene are resistant to prion infection[24] and depletion of PRNP expressed in neurons after infection is sufficient to prevent prion disease progression and reverse symptoms in mice[25]. Treatment of mice with intrathecally-injected antisense oligonucleotides (ASOs) targeting the Prnp transcript partially decreased expression of PRNP and extended the survival of mice upon infection with misfolded PRNP[26]; however, their limited efficacy and requirement for chronic dosing highlight the need for a more potent therapy. Importantly, both transgenic and naturally occurring PRNP knockout is well-tolerated in a variety of mammals[27,31]. The only known knockout phenotype is related to disruption of a myelin maintenance signaling pathway[32] in which homozygous knockouts exhibit mild peripheral neuropathy[33,34]. These data indicate that strategies aimed at reducing PRNP expression in neurons represent a viable therapeutic approach. Lessons learned in development of this therapeutic approach may be applied to other neurodegenerative diseases, as there is now accumulating evidence that Parkinson's, Alzheimer's, Huntington's, and other dementias involve protein aggregation as a central component of pathogenesis that can be targeted for therapeutic benefit[35,36]. Indeed, monoclonal antibodies targeting amyloid-beta plaques in early Alzheimer's disease patients show a modest delay in cognitive decline[37].

Epigenetic silencing represents an attractive approach for eliminating expression of pathogenic proteins like PRNP without the need to mutate the underlying DNA sequence[38]. Permanent silencing can be achieved through targeted DNA methylation by the recruitment of the catalytic domain of the de novo DNA methyltransferase enzyme DNMT3A (D3A) along with the C-terminal domain of its cofactor DNMT3L (D3L)[2]. DNA methylation at cytosine-guanine dinucleotide (CpG) sites, producing 5-methyl-CpGs (5mCpGs), is mitotically inherited and contributes to transcriptional silencing directly by blocking transcription factor binding and indirectly by recruiting methyl-CpG-binding factors that induce heterochromatin[39]. These domains, with the addition of a repressive KRAB domain, were fused to a nuclease-deficient S. pyogenes Cas9 (dCas9) yielding a CRISPR-based editor for programmable, heritable gene silencing termed CRISPRoff[1]. CRISPRoff has the benefit of a wide effective targeting window at gene promoters due to CpG methylation spreading, and its effect is generally stable through cell division and differentiation[1]. Prion disease is an excellent candidate for this approach, since simply decreasing PRNP expression will have a therapeutic effect[22] and the PRNP promoter contains a large annotated CpG island to serve as a substrate for DNA methylation. However, the complexity of the CRISPRoff system leads to challenges for delivery and toxicity as a therapeutic and necessitates the development of a more compact, potent, and safe epigenetic silencer.
The Prion Gene is a Viable Target for Durable Epigenetic Silencing.

Figure 15A:
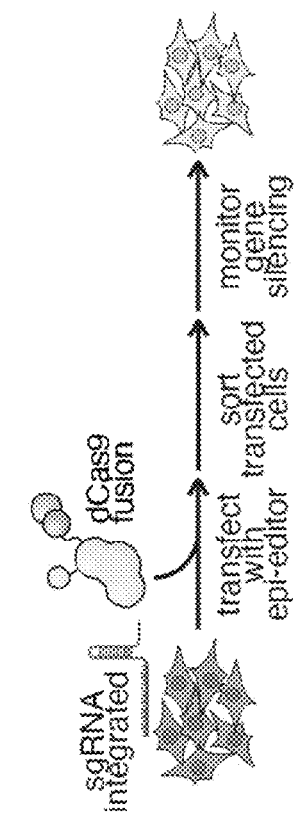
Figure 15C:
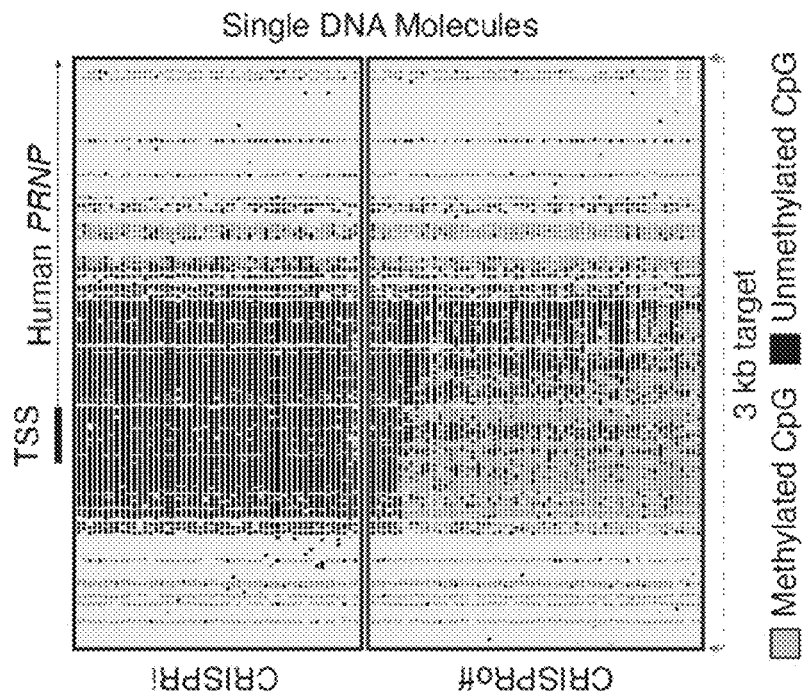
Figure 15B:
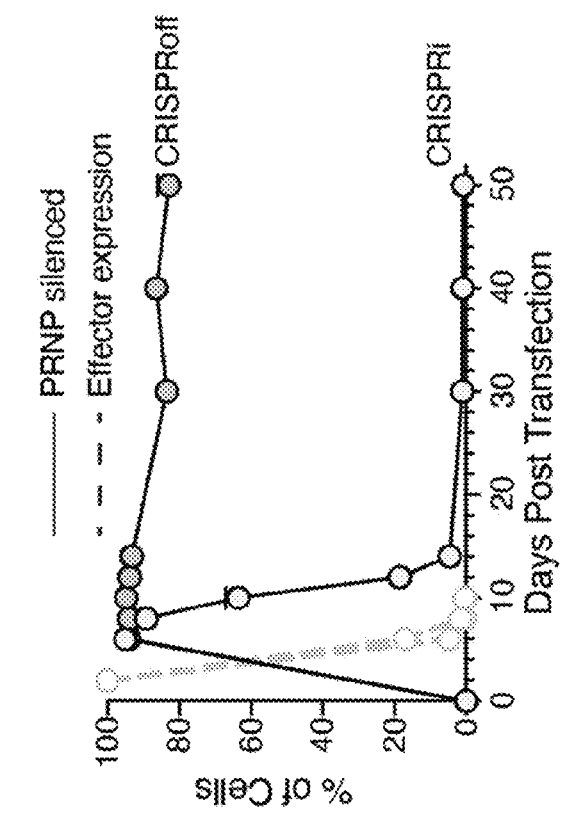

First, the suitability of the mouse and human PRNP gene to epigenetic silencing was assessed with targeted DNA methylation using CRISPRoff. HEK293T cells were transduced with a single guide RNA (sgRNA) targeting the transcription start site (TSS) of the PRNP gene. CRISPRoff and dCas9-KRAB (CRISPRi)[38] were introduced by transient transfection, and the level of PRNP expression was assessed by flow cytometry with fluorescent anti-PRNP antibodies (FIG. 15A). With a transient pulse of CRISPRoff effector, PRNP remains durably repressed for at least 50 days. By contrast, the repressive effect of CRISPRi was reversed rapidly upon loss of effector expression as expected (FIG. 15B). Target-enriched nanopore sequencing of native DNA confirmed extensive multi-kilobase DNA methylation across the CpG island (CGI) of the PRNP promoter region with the CRISPRoff treatment but not with CRISPRi (FIG. 15C). Similarly, targeting of CRISPRoff to mouse Prnp in Neuro-2a (N2a) cells led to silencing and methylation (FIGS. 15D & 16A-16D); this confirmed that mice would be a viable model for in vivo prion repression experiments using an epigenetic editor disclosed herein (see below).
Existing Epigenome Editors are Too Large or Too Toxic for Therapeutic Use.

In its current form, CRISPRoff is poorly suited to be a therapeutic for prion disease. The preferred vehicle for transgene delivery to the central nervous system (CNS) is the adeno-associated virus (AAV), which can be efficiently packaged with cargo around 4.8 kilobases in length including inverted terminal repeats[15]. The D3A-D3L-dCas9-KRAB fusion comprising CRISPRoff is approximately 6.2 kb long this far exceeds the packaging capacity of an AAV vector (FIG. 15E). Most of this space is occupied by the 4.1 kb coding sequence of S. pyogenes dCas9. Moreover, because AAV genomes form concatenated episomes that chronically express the transgene, the bacterial enzyme Cas9 is likely to become antigenic over time[40,41] indeed, a large proportion of the human population already has an immune memory of it[42]. To overcome these obstacles, dCas9 can be replaced with a different DNA-binding modality.

Zinc finger proteins (ZFPs) are ubiquitous DNA-binding proteins in eukaryotes[7] whose modular nature has enabled programming for specific genome targeting[8,43,44]. ZFPs offer some advantages as a therapeutically-relevant DNA targeting module. Their compact size, roughly an order of magnitude smaller than that of SpCas9, makes them suitable for delivery via an AAV vector (FIG. 15E). They are also less immunogenic due to their lack of bacterial epitopes[9]. ZFPs was used in effector constructs for targeted and heritable gene silencing. Engineered ZFPs fused to chromatin-modifying domains have been shown to successfully modulate gene transcription in vivo, as long as they are continuously expressed[10-13].

Figure 16A:
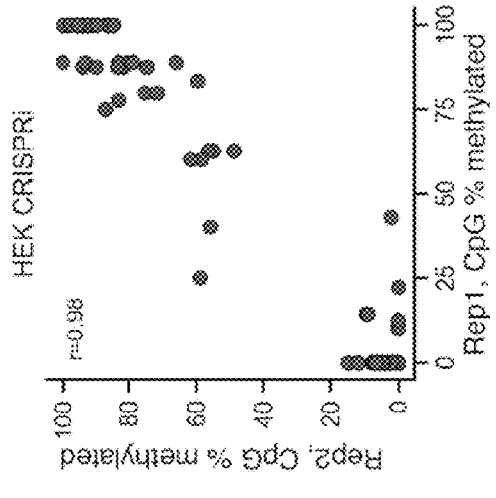
FIGS. 16A-16F Reproducibility of in vitro Nanopore analysis and DNMT3A recruitment.
Figure 16C:
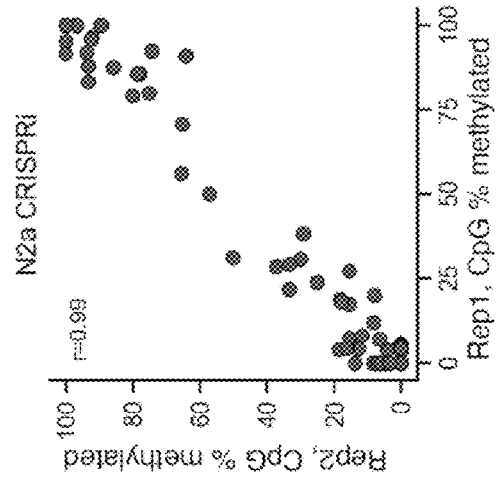
Figure 16B:
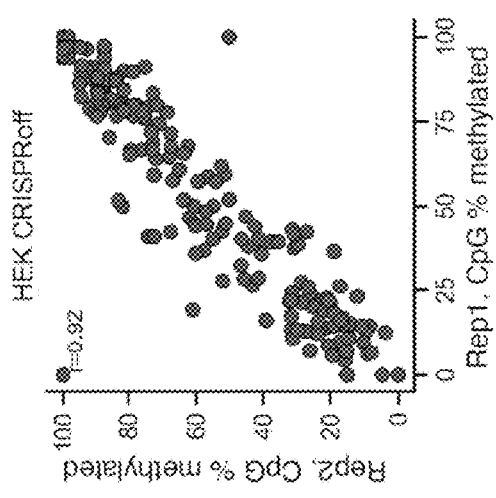
Figure 16D:
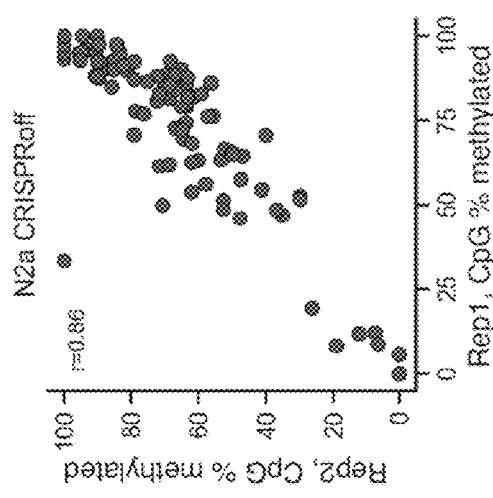
Figure 16E:
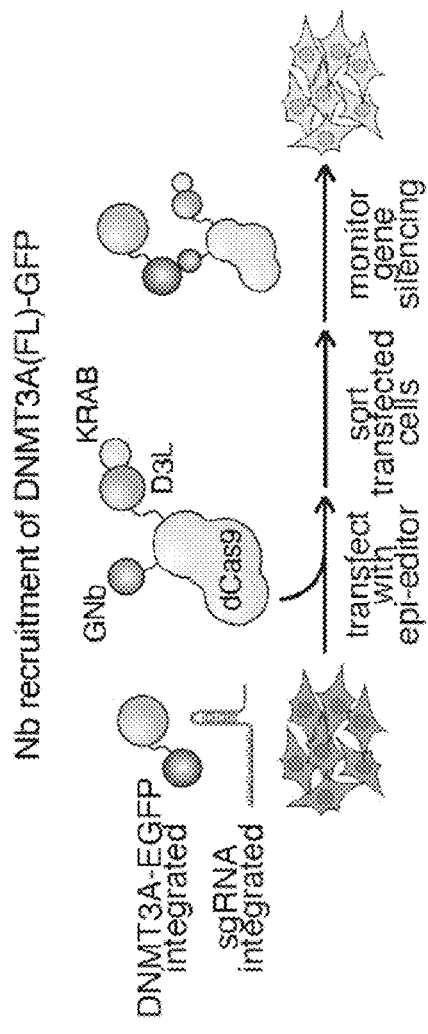
Figure 16F:
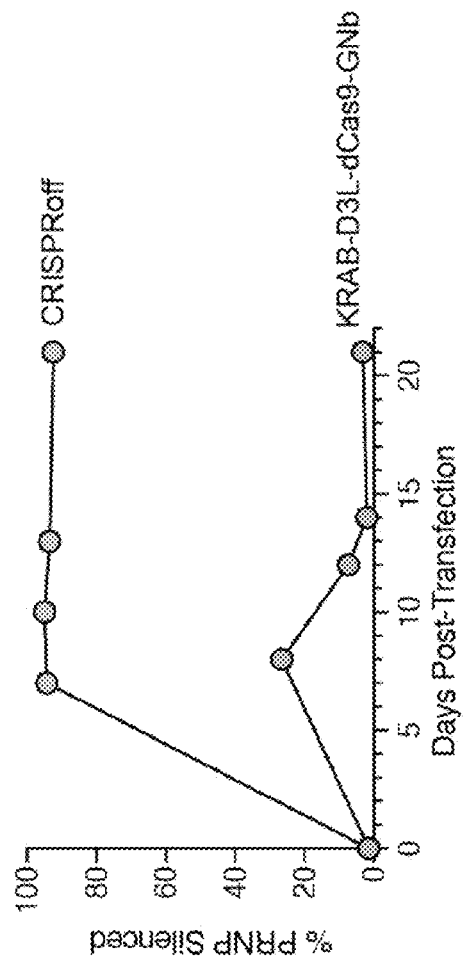

The next challenge to overcome is cytotoxicity. The full-length de novo methyltransferase is regulated by an autoinhibitory mechanism[45], which CRISPRoff bypasses by only using the catalytically-active methyltransferase domain[1]. The DNA methyltransferase catalytic domain on its own can have detrimental effects when overexpressed in target cells. Indeed, a ZFPoff construct transiently overexpressed in HEK293 cells exhibited substantial cytotoxicity whereas cells transfected by the same ZFP fusion without the D3A catalytic domain recovered quickly (FIGS. 15F-15G and see below). Attempts to instead recruit full-length DNMT3A for DNA methylation have previously been described[46]. However, when a single GFP nanobody[47] was used to bind EGFP-tagged DNMT3A, only poor activity was observed (FIGS. 16E-16F).

The dominant de novo methyltransferase in somatic tissues, particularly in the brain, is the isoform DNMT3A1 (hereinafter "DNMT3A1" or "DNMT3A"), whereas DNMT3B is virtually nonexistent[48]. In mammalian cells, DNA methylation by DNMT3A is tightly controlled through its two chromatin-reading domains: the ADD domain which reads unmethylated histone H3 lysine 4 (H3K4me0), an epigenetic mark absent from active promoters, and the PWWP domain, which reads trimethylated histone H3 lysine 36 (H3K36me3) enriched in transcribed gene bodies[45] (FIG. 17A). DNMT3A normally exists in an autoinhibited conformation in which its methyltransferase domain is occluded by its ADD domain, and this is only released upon binding of the ADD domain to H3K4me0 resulting in DNAme inversely correlated with H3K4 methylation[3,49,50]. Purified DNMT3A is indeed stimulated by a 12 amino acid H3K4me0 peptide to methylate a substrate in vitro[3,4,50]. Furthermore, DNMT3A complexes with DNMT3L in a 2:2 stoichiometry through hydrophobic contacts in their C-terminal domains[5]. This suggests that DNMT3L, which is catalytically inactive and has an ADD domain of its own (FIG. 17B), may help stabilize DNMT3A and could assist the active methyltransferase in seeking an appropriate target for DNAme[51]. DNMT3L co-immunoprecipitation experiments indicate that it interacts with both DNMT3A and DNMT3B to coordinate de novo DNAme[52]. These interactions will be the key to exploiting the endogenous pool of de novo methyltransferases for epigenetic editing strategies, thus eliminating the need to overexpress toxic quantities of the D3A catalytic domain.

A Fusion of the Histone H3 Tail and Dnmt3l C-Terminal Domain Efficiently Mediates Heritable Gene Silencing in Cells.

Figure 18A:
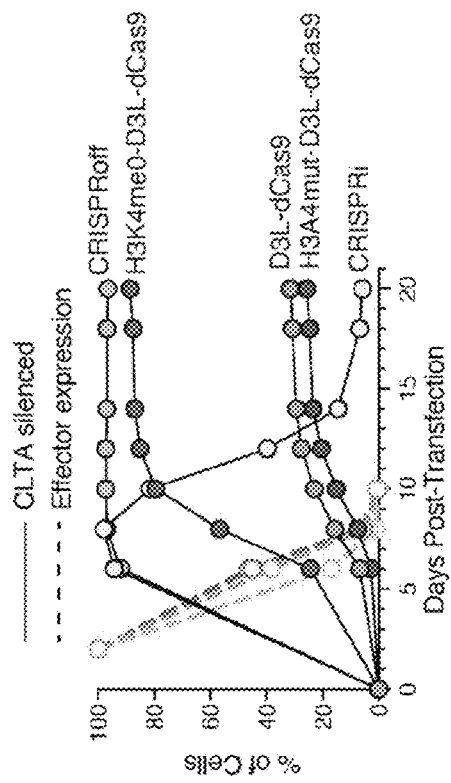
FIGS. 18A-18I A histone H3 tail fused to the Dnmt3l C-terminal domain acts as a potent mediator of DNA methylation and transcriptional silencing.

Taking advantage of the known interactions between DNMT3A, DNMT3L, and H3K4me0, a new strategy was developed for targeted DNA methylation and epigenetic silencing analogous but distinct to CRISPRoff by leveraging the use of the endogenous methyltransferases in cells. Rather than overexpressing the D3A methyltransferase domain as a fusion protein, full-length enzymes are instead recruited to a target site through interactions with a D3L domain, and their activities are stimulated by an unmethylated H3 tail (e.g., fused to an editor at the N-terminus). This novel type of D3A methyltransferase recruiting domain is designated CHARM: Coupled Histone tail for Autoinhibition Release of Methyltransferase. A CHARM effector comprises both a DNA-binding domain and CHARM, and is named after the DNA-binding domain, for example, a CRISPRcharm (see FIG. 18A for a cartoon depiction of a non-limiting example), a ZFcharm, and a TALEcharm.

Figure 18B:
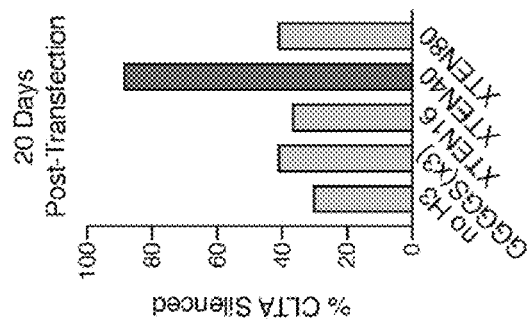
Figure 18C:
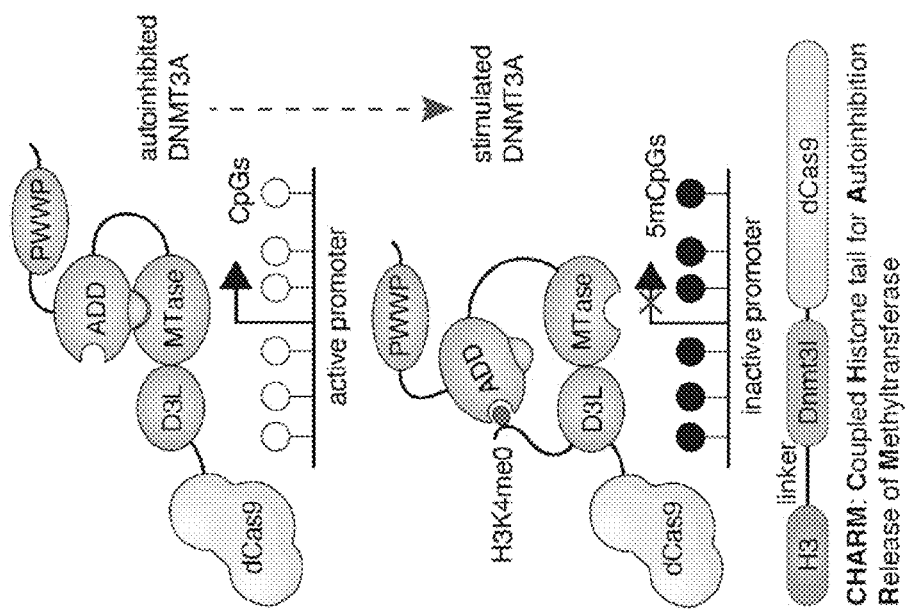

Using the CLTA gene tagged with mScarlet as a fluorescent reporter for endogenous gene silencing in HEK293T cells, several epigenetic editors, including the canonical CRISPRoff and CRISPRi constructs, were systematically compared. CRISPRoff silenced the reporter durably, CRISPRi repressed the reporter transiently, D3L-dCas9 had a minimal silencing effect, and the 12 aa H3K4me0 peptide fused to D3L-dCas9 resulted in silencing almost on par with CRISPRoff despite lacking the KRAB domain. To demonstrate that the unmethylated H3K4 residue is critical for endogenous DNMT3A stimulation, the lysine was mutated to alanine (H3A4). This mutant resulted in no silencing improvement over D3L-dCas9 alone (FIG. 18B), indicating the importance of the unmethylated histone H3 tail for stimulation of the endogenous methyltransferase. This H3 tail fusion was particularly sensitive to linker modifications connecting it to the D3L domain; in the first round of testing, only a 40 amino acid linker could achieve this activation effect (FIG. 18C). The importance of the autoinhibition release mechanism of the CHARM system was further shown by testing full-length DNMT3A direct fusions on the CLTA reporter where only the truncated D3A catalytic domain achieved the full silencing effect analogous to histone tail mediated activation of DNMT3A (FIG. 17C).

To verify that this effect is due to the mechanism of histone tail binding the ADD domain of the methyltransferase rather than simply stabilizing or altering expression of the fusion protein, a transfection dose titration was performed comparing D3L with or without the H3 tail. At 18 days post-transfection, there was little difference in silencing activity across transfected DNA concentrations, indicating that the epi-editor is unlikely to be dose-limited (FIG. 17D). Likewise, by gating for different levels of expression while sorting the transfected cells, there appears to be no improvement in silencing efficacy by day 16 post-transfection (FIGS. 17E-17F). This indicates that activity of the epi-editor is not limited by translation or stability of the fusion protein.

CHARM Optimization

Figure 18E:
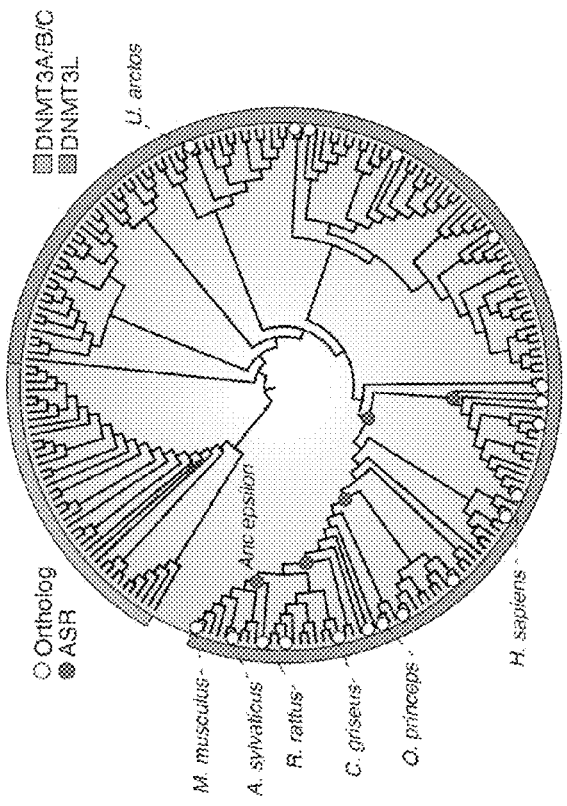
Figure 18D:
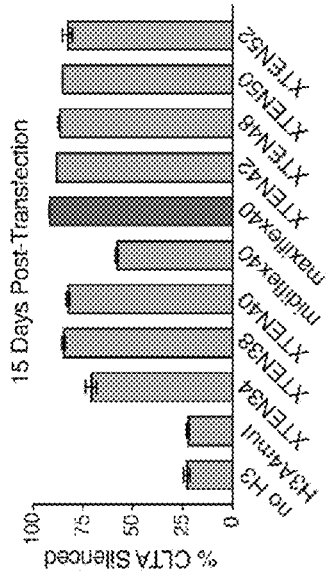

Next, a CHARM effector was optimized by manipulating various parameters of the fusion protein. First, a range of linker lengths centered around the established 40-amino acid length were tested. The canonical XTEN linker amino acid sequence was also modified to increase the flexibility through the removal of proline residues to generate the "midiflex" and "maxiflex" linker variants following general linker engineering guidelines[53]. A 40-amino acid maxiflex linker (GGASSGAGSSSGGSAAGSGSS-GASGSSGSASSGSGSGGSG (SEQ ID NO:96)) provided a modest increase in silencing activity (FIG. 18D); and a CRISPRcharm comprising said 40-amino acid maxiflex linker was designated CRISPRcharm1. Attempts to boost activity by increasing nuclear localization through the addition of an N-terminal nuclear localization signal (NLS), or by appending two H3 tails in tandem, were unsuccessful (FIG. 17G); these data suggest that having a free N-terminus is critical for CHARM function.

Figure 18G:
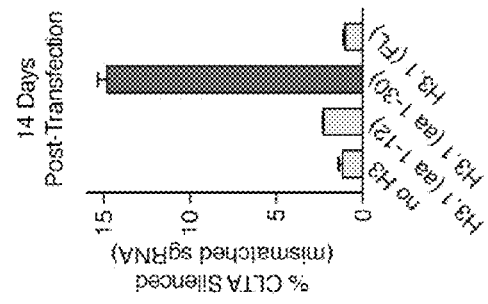
Figure 18F:
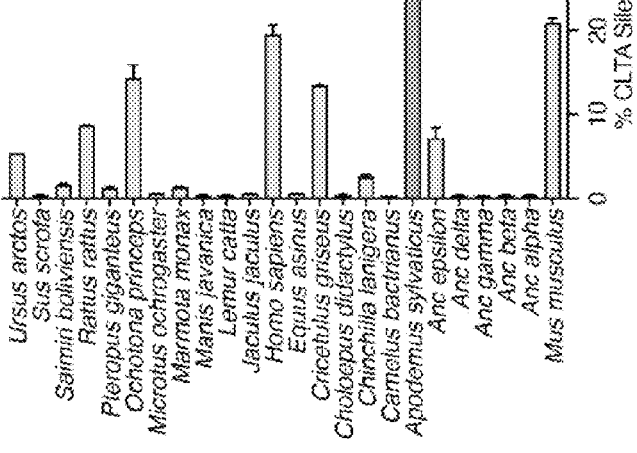

Another variable to optimize was the D3L domain sequence, which is critical for methyltransferase recruitment and stabilization. Rather than performing random mutagenesis, the extant universe of D3L domains orthologous to the canonical *Mus musculus* D3L, as well as some ancestral reconstructions (ASRs)[6] between the rodent and primate clades (FIG. 18E), was explored. CHARMs comprising one of approximately two dozen D3L orthologs and ASRs fused to dCas9 were tested on the CLTA reporter. The most active editor, designated CRISPRcharm2, comprises the D3L domain of the European wood mouse *Apodemus sylvaticus* (AsD3L) (FIG. 18F).

Figure 18H:
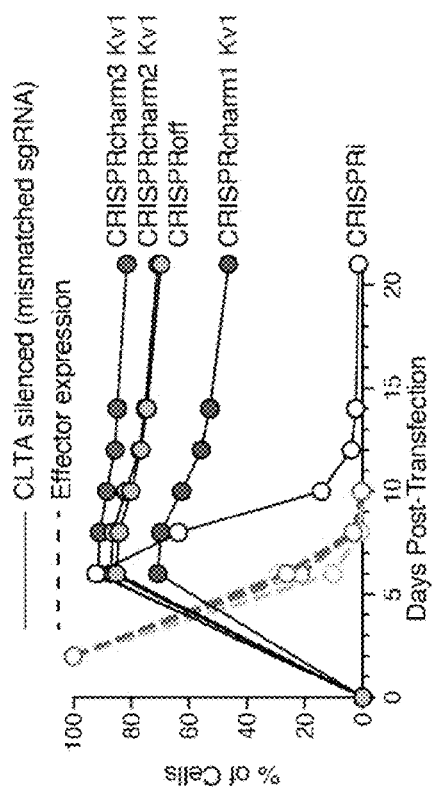

While the first 12 amino acids of the histone H3 tail were sufficient to stimulate methylation activity, a longer portion of the flexible tail region of histone H3.1 may have a higher affinity for the ADD domain of DNMT3A. Two effectors, one comprises a 30-amino acid H3 tail, and the other comprises the full-length H3.1 protein including the globular domain, were recruited to the CLTA reporter using a mismatched sgRNA to avoid saturation of the transcriptional silencing signal. Including the 30-amino acid H3 tail produced a more potent CHARM effector designated CRISPRcharm3 (hereinafter "CRISPRcharm3" or "CRISPRcharm") (FIG. 18G). These optimization efforts led to a CHARM effector exceeding the transcriptional silencing capabilities of CRISPRoff (FIG. 18H) when a KRAB domain was fused to the C-terminus of CHARM effectors comprising dCas9, as in CRISPRoff[1]. Schematics of each of these CHARM epigenetic editors can be found in FIG. 17H, with the optimized version without the KRAB domain being hereby referred to as CRISPRcharm.

Figure 18I:
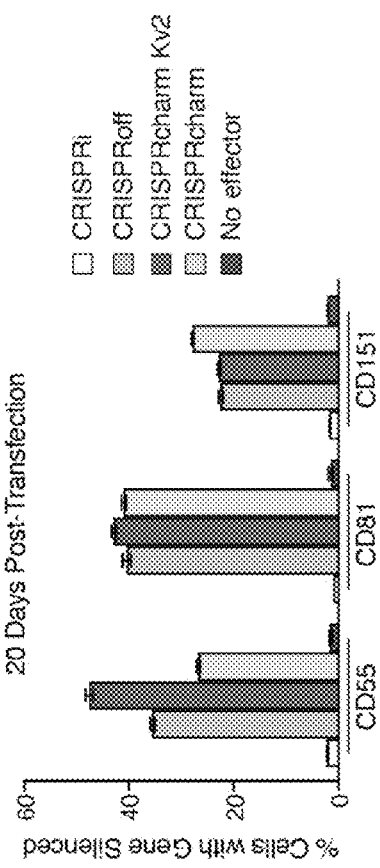

A KRAB domain could be incorporated into a flexible linker between a H3 tail and a D3L. Two KRAB domain-containing variants were named CRISPRcharm Kv1 and Kv2, respectively, and both can efficiently repress the CLTA reporter (FIG. 17I). To demonstrate broad targeting capabilities of the new CHARM effectors, CRISPRoff, CRISPRcharm, and CRISPRcharm Kv2 were targeted to three cell surface markers using HEK293T cells with pre-integrated sgRNAs. Antibody staining and flow cytometry revealed durable repression out to about three weeks on par with CRISPRoff (FIG. 18I), suggesting that CHARM effectors can be effective at any target amenable to DNA methylation-mediated silencing.

CHARMs are Compatible with Different DNA-Binding Domains.

After optimizing CHARM effectors using CRISPR-dCas9 recruitment to an endogenous CLTA reporter, different DNA-binding modalities were used to reduce transgene size and facilitate packaging into an AAV vector. DCas9 in CRISPRcharm Kv1 was replaced with previously published ZFPs targeting the mouse Prnp promoter (ZFPs 81187 and 81201)54 to generate ZFcharm Kv1. These were transiently transfected into N2a cells and achieved durable Prnp silencing out to one month (FIG. 19A). Transcription activator-like effectors (TALEs), another mode of programmable DNA-binding domain, have also been shown to enable targeted DNA methylation[14]. TALEs can be easier to design than ZFPs, and TALEcharms comprising chimeric TALEs[55] successfully targeted the mouse Prnp promoter (FIG. 19B).

TABLE 2

PRNP TALEs

| | Amino Acid Sequence SEQ ID | Binding Site SEQ ID |
|---|---|---|
| Human PRNP TALEs | | |
| HsT3x | NO: 454 | NO: 438 |
| HsT4x | NO: 455 | NO: 439 |
| HsT5x | NO: 456 | NO: 440 |
| HsT6x | NO: 457 | NO: 441 |
| HsT7x | NO: 458 | NO: 442 |
| HsT36x | NO: 459 | NO: 443 |
| HsT39x | NO: 460 | NO: 444 |
| HsT42x | NO: 461 | NO: 445 |
| Mouse Prnp TALEs | | |
| MmT4x | NO: 462 | NO: 446 |
| MmT8x | NO: 463 | NO: 447 |
| MmT11x | NO: 464 | NO: 448 |
| MmT12x | NO: 465 | NO: 449 |
| MmT18x | NO: 466 | NO: 450 |
| MmT25x | NO: 467 | NO: 451 |
| MmT32x | NO: 468 | NO: 452 |
| MmT36x | NO: 469 | NO: 453 |

TABLE 3

TALEcharms

| Nomenclature | Domains | |
|---|---|---|
| TALEcharm Kv2 HsT3x | A-TALE_HsT3x-bpNLS | NO: 470 |
| TALEcharm Kv2 HsT4x | A-TALE_HsT4x-bpNLS | NO: 471 |
| TALEcharm Kv2 HsT5x | A-TALE_HsT5x-bpNLS | NO: 472 |
| TALEcharm Kv2 HsT6x | A-TALE_HsT6x-bpNLS | NO: 473 |
| TALEcharm Kv2 HsT7x | A-TALE_HsT7x-bpNLS | NO: 474 |
| TALEcharm Kv2 HsT36x | A-TALE_HsT36x-bpNLS | NO: 475 |
| TALEcharm Kv2 HsT39x | A-TALE_HsT39x-bpNLS | NO: 476 |
| TALEcharm Kv2 HsT42x | A-TALE_HsT42x-bpNLS | NO: 477 |
| TALEcharm Kv2 MmT4x | A-TALE_MmT4x-bpNLS | NO: 478 |
| TALEcharm Kv2 MmT8x | A-TALE_MmT8x-bpNLS | NO: 479 |
| TALEcharm Kv2 MmT11x | A-TALE_MmT11x-bpNLS | NO: 480 |
| TALEcharm Kv2 MmT12x | A-TALE_MmT12x-bpNLS | NO: 481 |
| TALEcharm Kv2 MmT18x | A-TALE_MmT18x-bpNLS | NO: 482 |
| TALEcharm Kv2 MmT25x | A-TALE_MmT25x-bpNLS | NO: 483 |
| TALEcharm Kv2 MmT32x | A-TALE_MmT32x-bpNLS | NO: 484 |
| TALEcharm Kv2 MmT36x | A-TALE_MmT36x-bpNLS | NO: 485 |
| TALEcharm HsT7x | B-TALE_HsT7x-bpNLS | NO: 486 |
| TALEcharm MmT8x | B-TALE_MmT8x-bpNLS | NO: 487 |

Figures 19E, 19F:
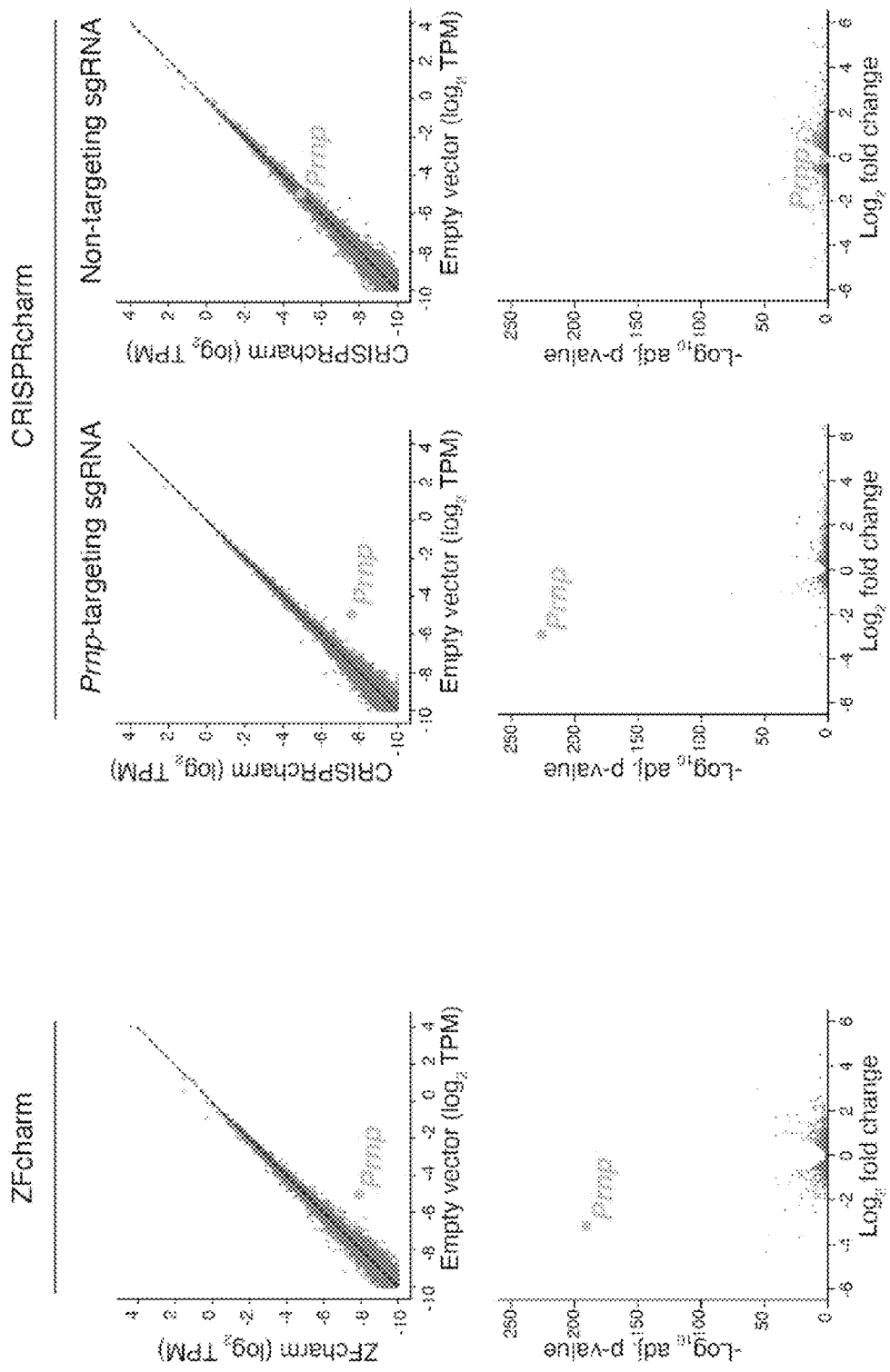
Figure 20A:
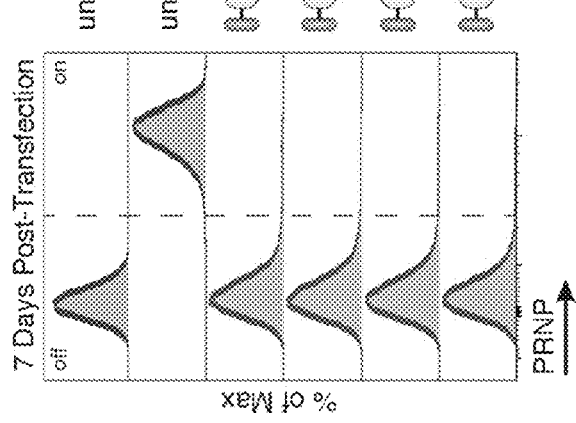
FIGS. 20A-20C CHARM variations using split-inteins or a small Cas effector.

A: H3(30aa)-maxiflex32-KRAB-XTEN16-AsD3L-XTEN80-bpNLS
B: H3(30aa)-maxiflex40-AsD3L-XTEN80-bpNLS The relatively small sizes of ZFcharms and TALEcharms enable flexible single-vector AAV packaging strategies. A split *Nostoc punctiforme* (Npu) intein strategy was leveraged for trans-splicing of polypeptides[19,20]. ZFcharms comprising a single CHARM (with an N-terminal Npu intein) and two or more ZFP DNA-binding domains (each with a C-terminal Npu intein) were constructed (see, e.g., FIG. 19C). The single CHARM and the two or more ZFP DNA-binding domains were separated by 2A ribosome skipping sequences, enabling generation of two or more distinct polypeptide chains from the same mRNA transcript. A polypeptide spliced together to form a complete ZFcharm molecule was as effective at silencing PRNP as a direct fusion (FIG. 20A).

Transgenes encoding a single CHARM and two or more distinct DNA-binding domains, having a size of 5 kb or less, were designed for multiplexed targeting. The compact size further enables special and/or temporal control of gene silencing, for example, by a small molecule. See, e.g., FIG. 19C, binding to tamoxifen induces nuclear localization of an engineered estrogen receptor[21]. A CHARM effector can also turn itself off, when coupled to a DNA binding domain (e.g., a ZFP) targeting its transgene promoter (see below).

Figure 20B:
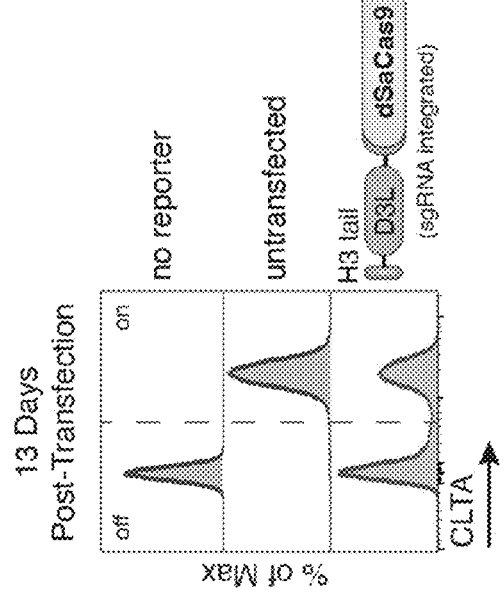

Besides ZFPs, efficient targeting and gene silencing were also observed with both *S. pyogenes* CRISPR-Cas9 and TAL effector modalities. It is thus highly likely that CHARMs are broadly compatible with other DNA-binding domains. Indeed, efficient silencing of the CLTA reporter was demonstrated using the smaller *S. aureus* Cas9 (dSaCas9charm: H3(30aa)-maxiflex40-AsD3L-XTEN80-bpNLS-dSaCas9-bpNLS (SEQ ID NO:488); dSaCas9 (SEQ ID NO:489)), which is more amenable to AAV packaging[57] (FIG. 20B).

CHARMs Exhibit Low Toxicity with High Specificity.

Profound cytotoxicity was associated with transient overexpression of ZFoff, but not with D3L-ZFP-KRAB lacking a catalytic D3A domain (FIG. 19D). It was therefore hypothesized that ZFcharms, with D3A replaced by a short histone tail peptide and lacking catalytic activity on their own, would also be better-tolerated in cells. The bystander effect of ZFcharm Kv1 expression was quantified by transiently transfecting HEK293T cells, isolating transfected cells using FACS, and staining and counting cells with a viability dye. ZFoff-transfected cells were significantly less viable six days after transfection, whereas ZFcharm Kv1-transfected cells recovered quickly and were indistinguishable from cells transfected with ZFP lacking any effector domains (FIG. 19D).

Figure 20C:
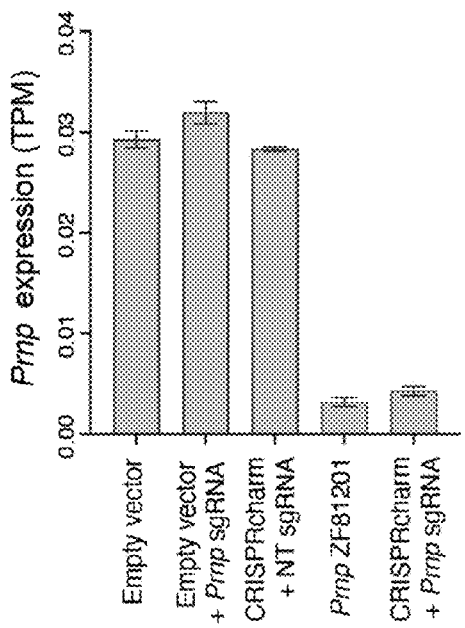

To assess the specificity of ZFcharm Kv1, RNA sequencing was performed 28 days post-transduction of N2a cells by lentivirus containing ZFcharm Kv1 targeting Prnp. Minimal off-target gene repression was observed (FIG. 19E). This is consistent with the analysis of N2a cells transduced with CRISPRcharm Kv1 and sgRNA targeting the same Prnp locus or with a non-targeting sgRNA (FIG. 19F), suggesting that CHARM expression has minimal bystander effects and its specificity is largely dictated by the DNA-binding domain. Likewise, the knockdown of Prnp transcripts was quantified, and nearly complete repression was observed when compared to non-targeting or effector-null conditions (FIG. 20C).

AAV-Delivered CHARMS Repress and Methylate Prnp In Vivo.

Figure 21B:
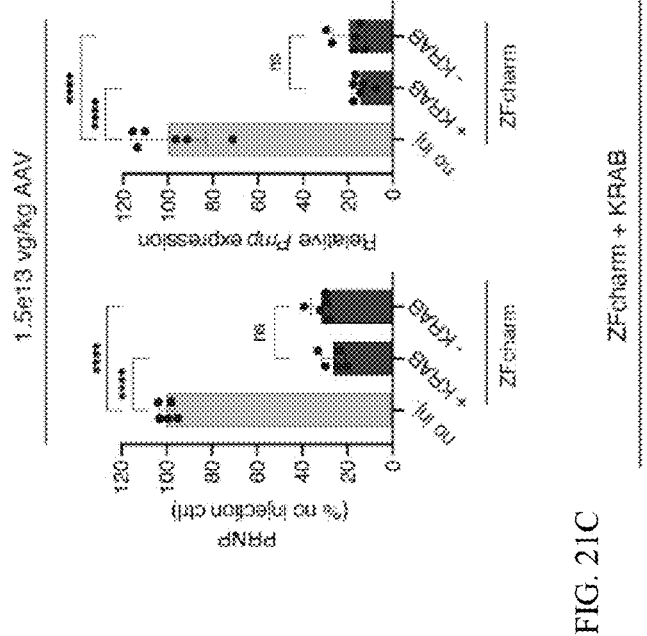
FIGS. 21A-21H AAV-delivered ZFcharms repress and methylate Prnp in vivo.
Figure 21C:
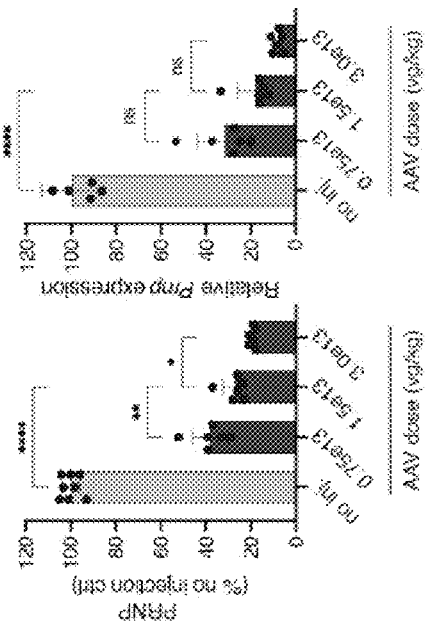
Figure 21A:
Figure 21D:
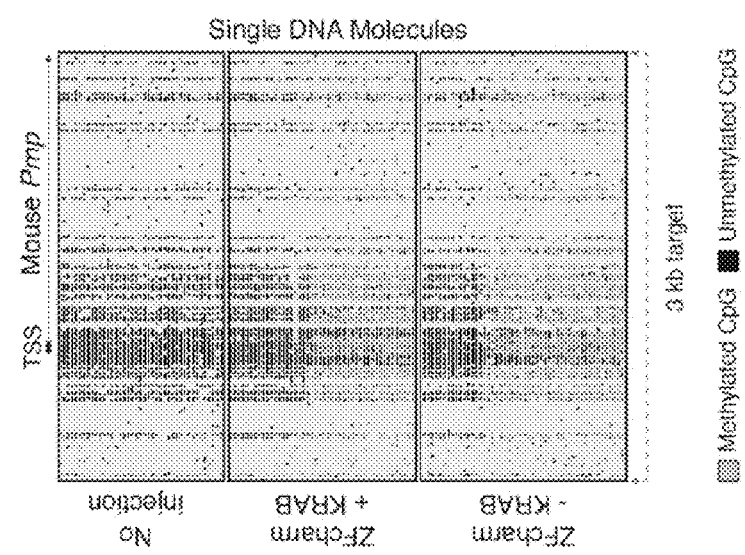

Having achieved CHARM-mediated heritable Prnp silencing in cultured cells, silencing efficacy in vivo was tested through AAV delivery to the mouse brain. Constructs with or without the KRAB domain (i.e., ZFcharm Kv1 or ZFcharm) were packaged into AAV-PHP.eB capsids optimized for superior transduction efficiency to the CNS through directed evolution[58]. Viral genomes at 1.5e13 per kilogram AAV (vg/kg) was delivered to adult mice by retro-orbital injection and harvested whole brains six weeks post injection (FIG. 21A). PRNP ELISA and Prnp RT-qPCR assays on homogenized brain hemispheres revealed a 60-80% reduction in PRNP protein levels and a 70-90% decrease in Prnp transcripts, respectively. In addition, ZFcharms (lacking the KRAB domain) were highly effective, suggesting DNA methylation alone is sufficient to silence Prnp in the brain (FIG. 21B). These levels of knockdown far exceed the efficacy reached via ASO delivery previously shown to be protective against prion disease[26]. Doubling the AAV dose led to a mild improvement in Prnp repression and reduced inter-individual variability (FIG. 21C). No adverse effects were detected at any of the administered doses, but subsequent experiments were conducted at the intermediate dose of 1.5e13 vg/kg given that the higher dose yielded only modest gains. Nanopore sequencing of the 3 kb surrounding the Prnp promoter region showed that both ZFcharm and ZFcharm Kv1 established DNA methylation of CpGs surrounding the transcriptional start site (TSS) (FIG. 21D). CHARMs can therefore recruit de novo DNA methyltransferases endogenously expressed in the brain and effectively release enzymatic autoinhibition in vivo.

Figure 21F:
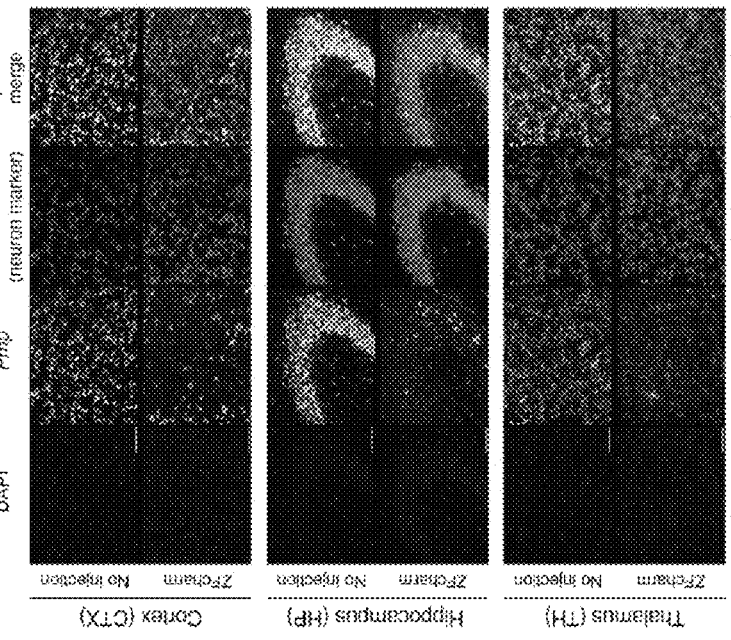
Figure 21I:
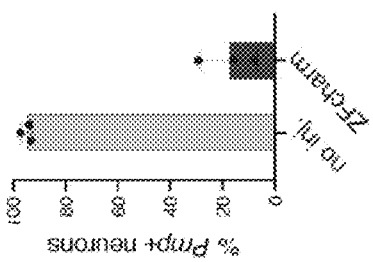
FIG. 21I Bar chart showing % Prnp+ neurons in treated and untreated brains based on QuPath classification.
Figure 21H:
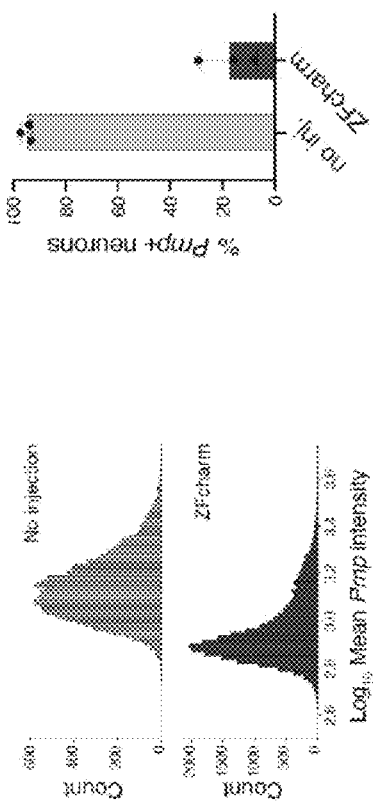
Figure 21E:
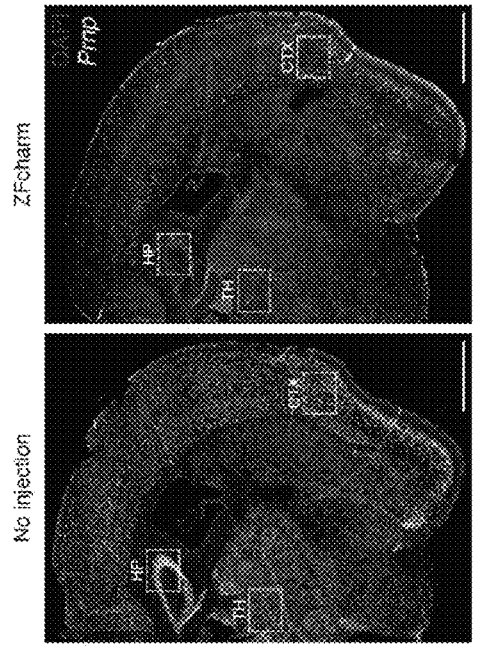
Figure 21G:
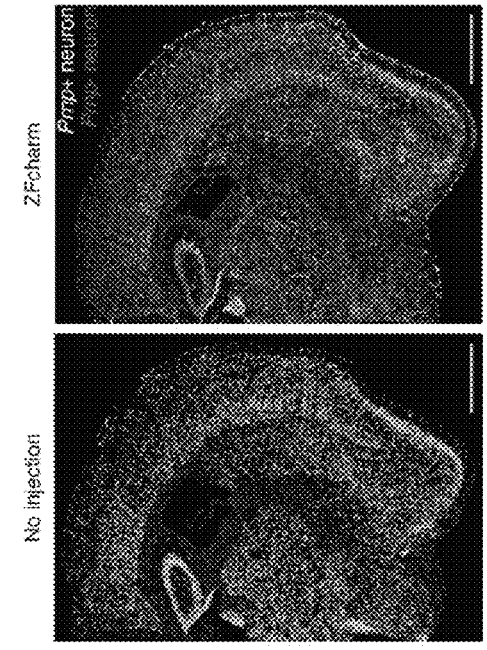

In situ hybridization chain reaction (HCR) RNA-FISH was performed on coronal brain sections to visualize Prnp expression six weeks post injection. Robust Prnp silencing was evident across the brain, highlighting the broad CNS biodistribution attained by the AAV-PhP.eB capsid (FIGS. 21E-21F). Using QuPath software and HCR probes against Uch11 (a pan-neuronal marker), the number of neurons expressing Prnp in treated and untreated brains were quantified. Prnp was transcriptionally silent in the vast majority of neurons in ZFcharm Kv1-treated brains, consistent with the data from whole brain homogenate (FIGS. 21F-21I). This analysis establishes CHARM effectors as potent epigenetic silencers in critical, therapeutically relevant cell types, as Prnp depletion in neurons alone is sufficient to prevent prion disease in mice[25,60,61]. More broadly, it demonstrates that the CHARM technology is functional in post-mitotic cells.

CHARMs can be Programmed for Time-Limited Expression Through Self-Silencing

AAV-mediated delivery of transgenes in non-dividing cells results in chronic expression from episomal AAV genomes, raising potential antigenicity and off-target editing concerns. As a result, previous efforts have aimed to restrict AAV expression once the desired therapeutic edits are accomplished[62-64]. This feature is well-suited for an epigenetic editor which does not require constitutive expression to maintain gene silencing.

To achieve this, a self-silencing CHARM, which targets its own promoter after silencing it target, was developed. A ZFP-binding motif from the Prnp promoter was installed at positions flanking the core EF1α (EFS) promoter driving transgene expression (FIG. 22A). The self-silencing kinetics in N2a cells was assessed by measuring ZFcharm Kv1 and Prnp expression over time following lentiviral infection of constructs containing the following binding site configurations: (1) two binding sites flanking the promoter (double perfect match; ZFcharm Kv1-DPM), (2) one binding site upstream of the promoter (single perfect match; ZFcharm Kv1-SPM), (3) one binding site upstream of the promoter with a mismatch to decrease binding affinity (single mismatch; ZFcharm Kv1-SMM), and (4) a scrambled sequence as a negative control (scrambled; ZFcharm Kv1-SCR) (FIGS. 22A-22B).

Figure 22E:
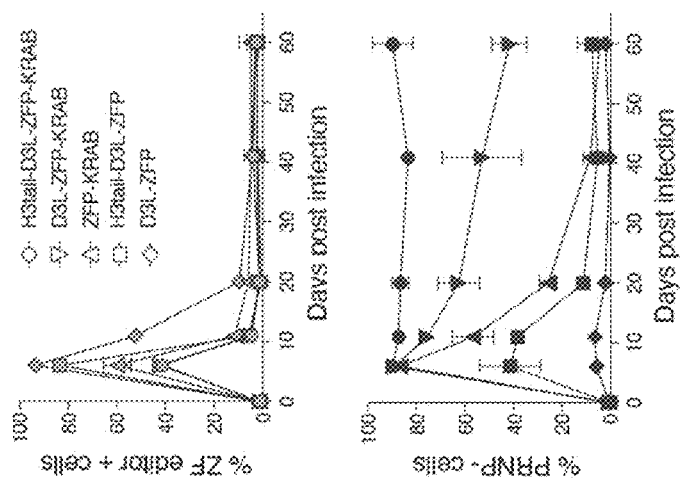
Figure 23A:
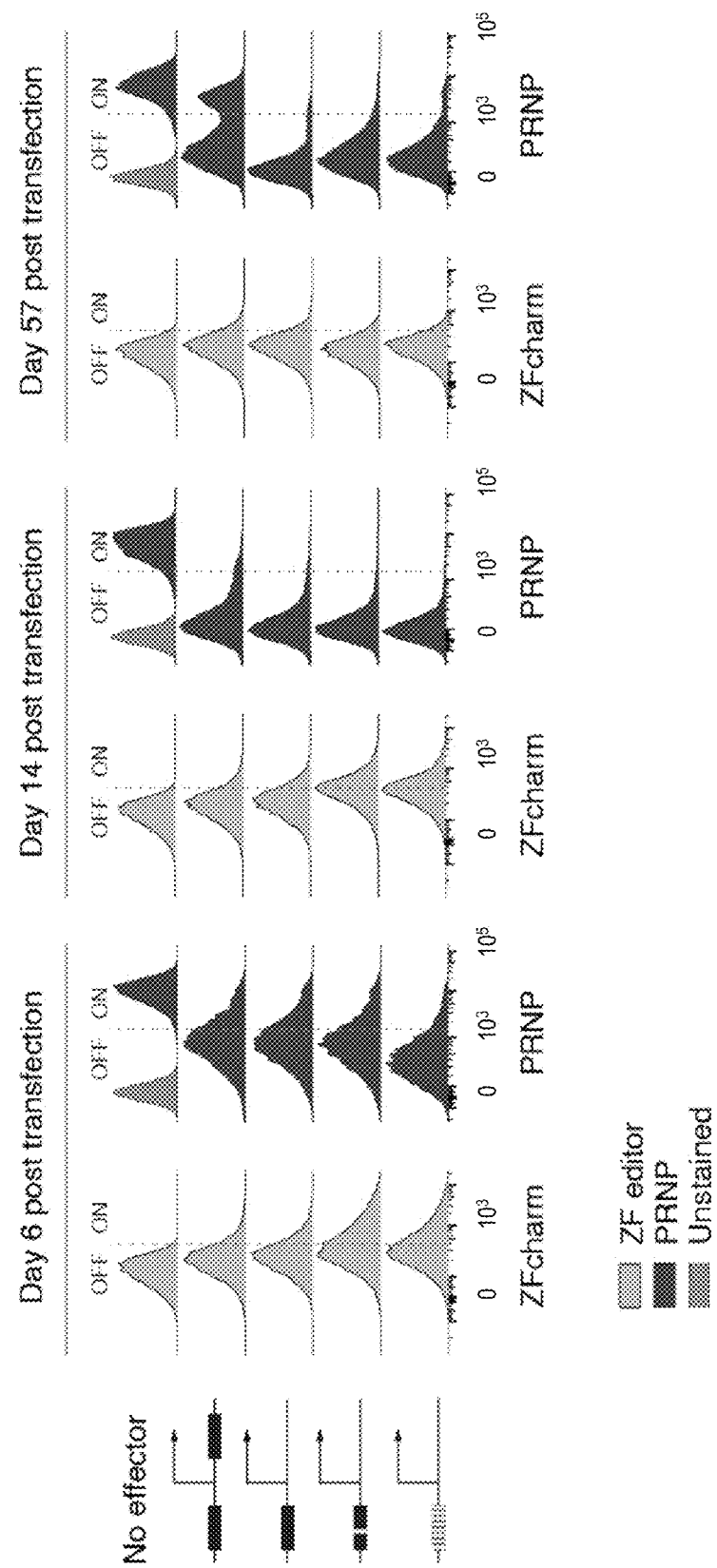
FIGS. 23A-23D Confirmation of ZFcharm self-silencing efficacy.

Flow cytometry quantification showed that all constructs initially induced complete repression of Prnp as well as differential rates of self-silencing (FIG. 22C). By 60 days post-transduction, ZFcharm Kv1was fully silenced across all conditions, yet Prnp was reactivated in a subset of cells transduced with ZFcharm Kv1-DPM. It is likely that the KRAB domain facilitated rapid repression of Prnp initially, but self-silencing occurred too rapidly to establish lasting repression via DNA methylation (FIG. 22C). These findings are generalizable beyond lentiviral assays, as integrating the self-silencing constructs using the piggyBac transposase system produced consistent results (FIG. 23A).

Figure 22D:
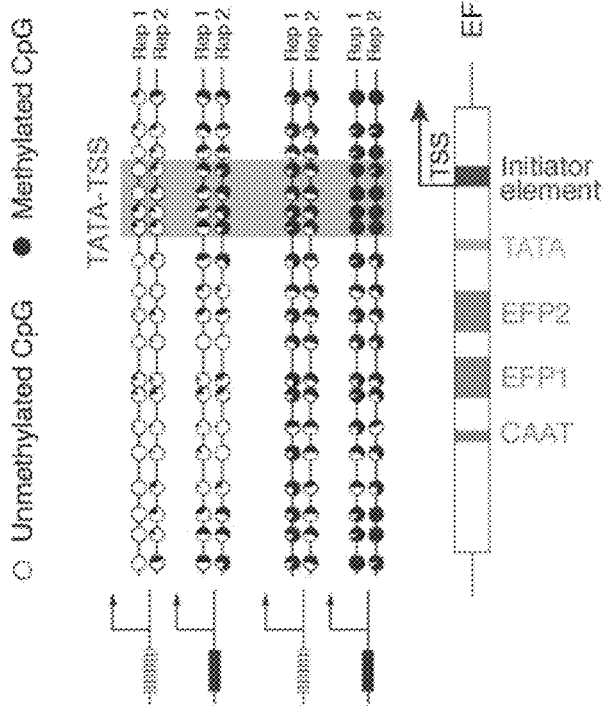
Figure 23B:
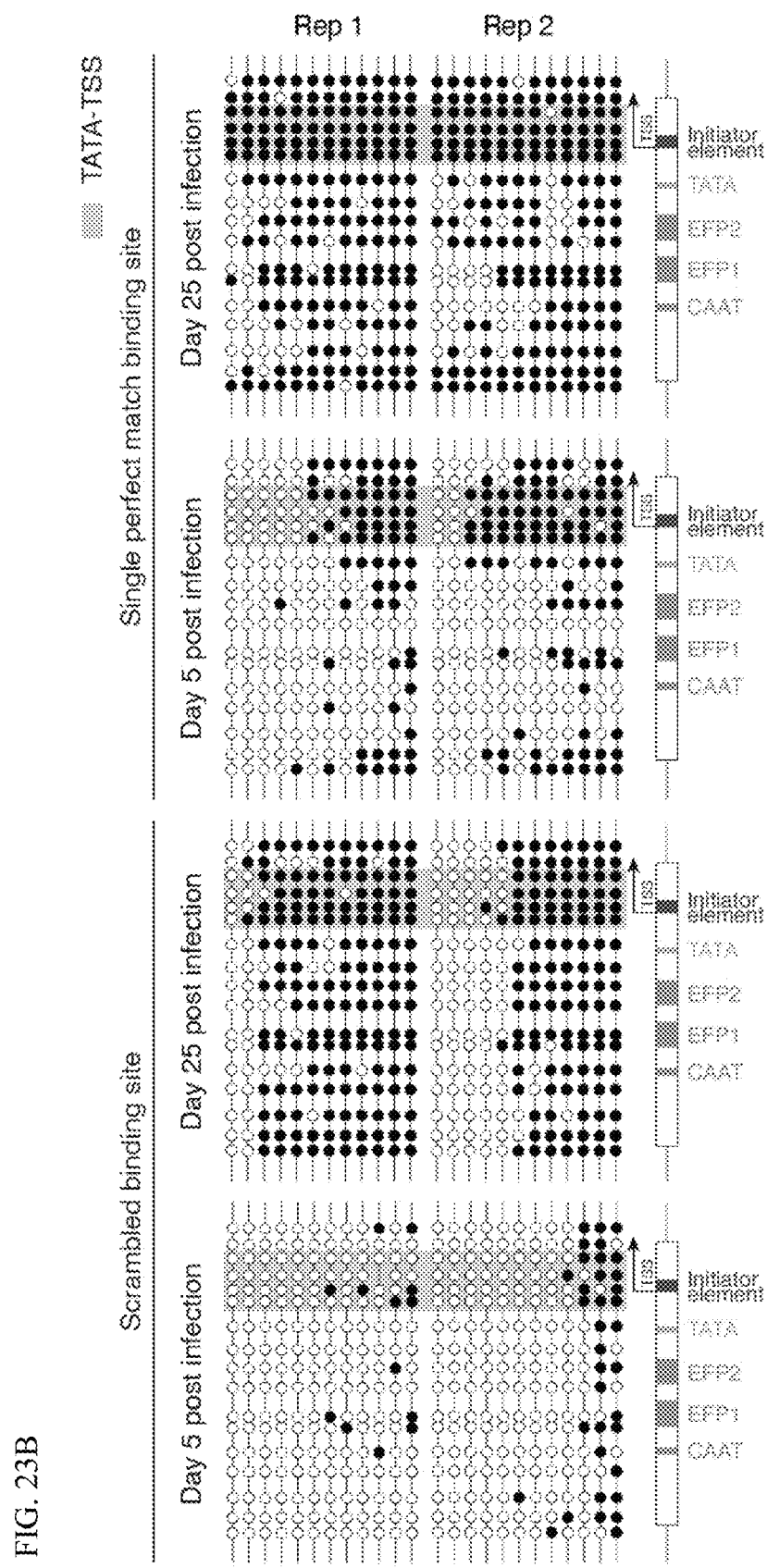
Figure 23C:
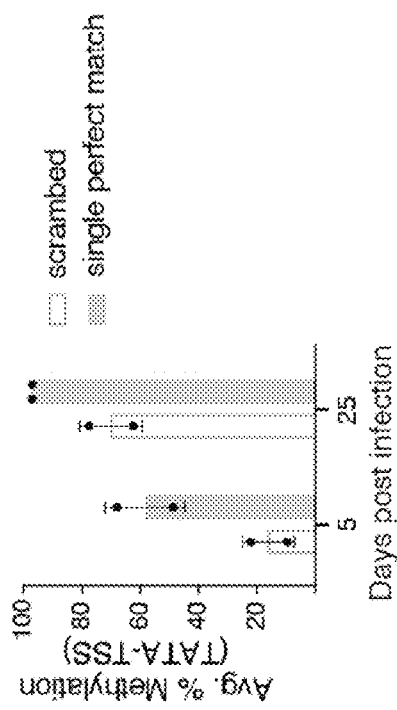

ZFcharm Kv1-SPM was selected for further characterization as it minimized the length of CHARM expression without compromising heritable silencing. Clonal bisulfite sequencing of the ZFcharm Kv1-SPM promoter revealed an accumulation of DNA methylation five days post infection, particularly between the TATA box and the TSS (FIGS. 22D & 23B-23C). By day 25, this region was completely methylated (FIGS. 22D & 23B-23C). The promoter with a scrambled binding site also gained methylation over time, but in a slower and more dispersed fashion (FIGS. 22D & 23B). This gain in methylation and eventual loss of ZFcharm Kv1-SCR expression is attributed to self-silencing-independent transgene silencing[65].

Figure 22F:
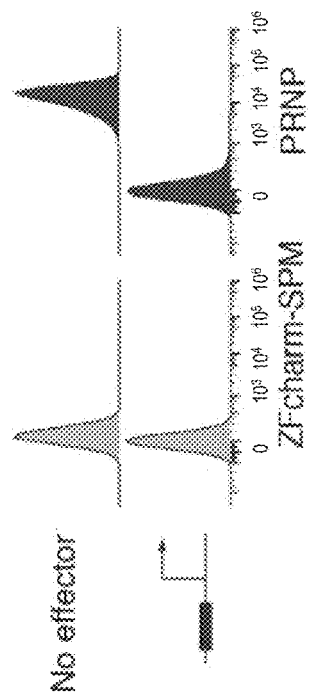
Figure 23D:
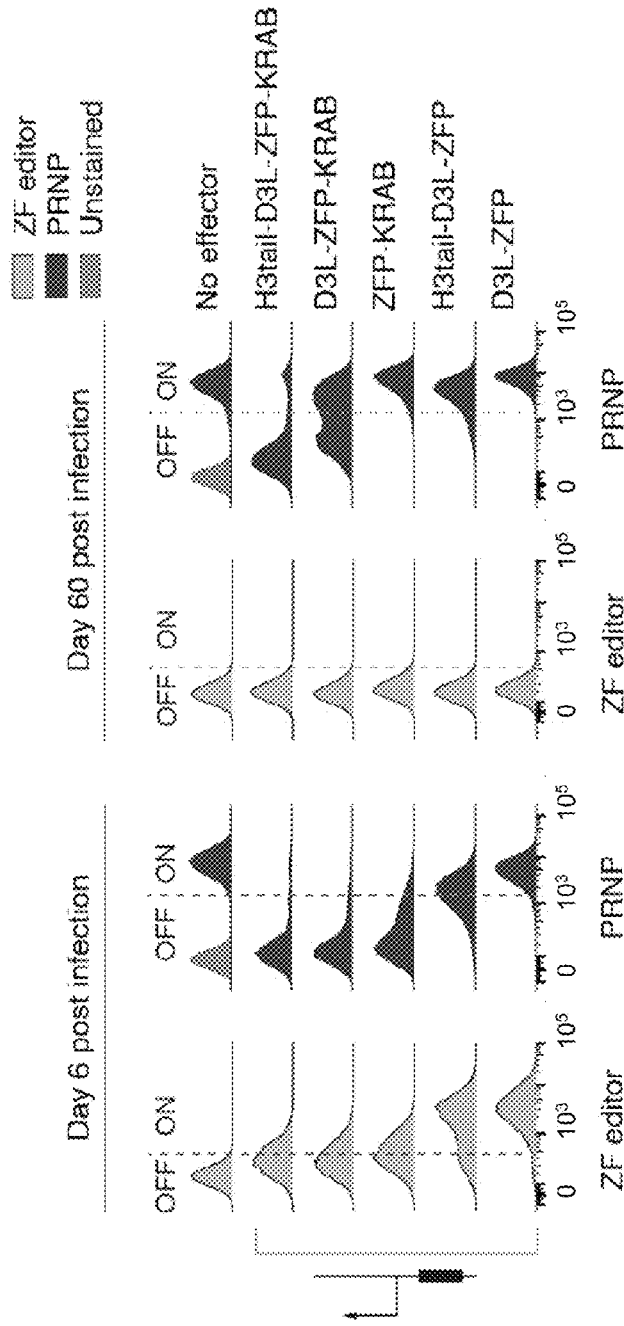

To investigate the essentiality of each ZF-charm component, ZFcharm Kv1-SPM was compared to other ZF-SPM constructs lacking one or more domains. While all editors became self-silenced, only ZFcharm Kv1-SPM showed stable repression of Prnp over time (FIGS. 22E & 23D). Indeed, Prnp remained transcriptionally silent six months post ZFcharm Kv1-SPM infection (FIG. 22F). In contrast to the in vivo data, the KRAB domain was required for robust Prnp repression in the context of dividing cells in culture (FIGS. 21B, 22E, & 23D).

Figure 22G:
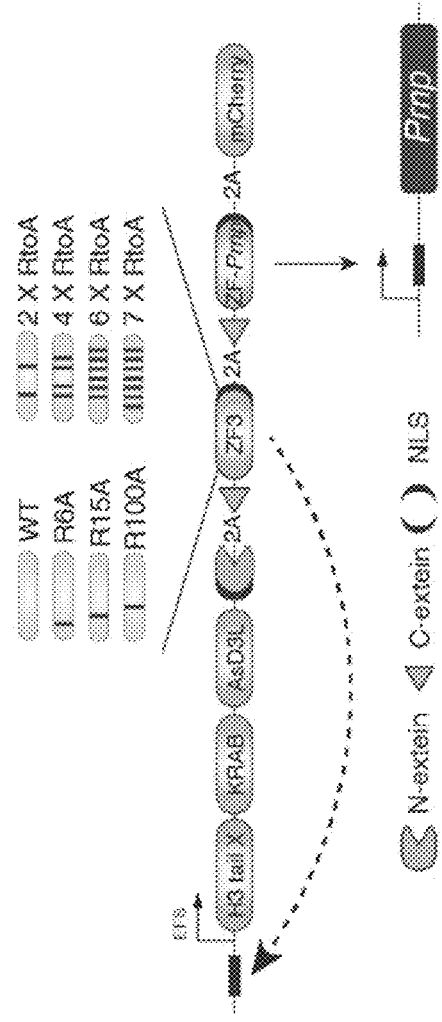
Figure 25A:
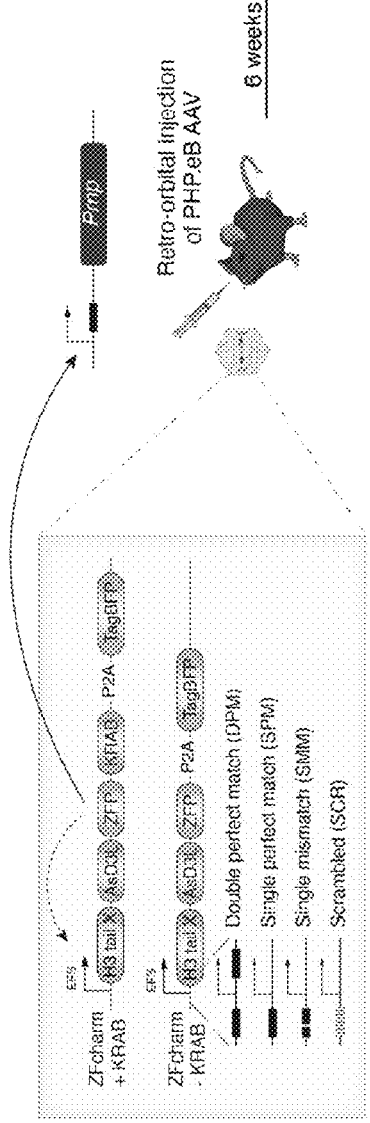
FIGS. 25A-25E Self-silencing ZFcharm is functional in vivo.
Figure 25C:
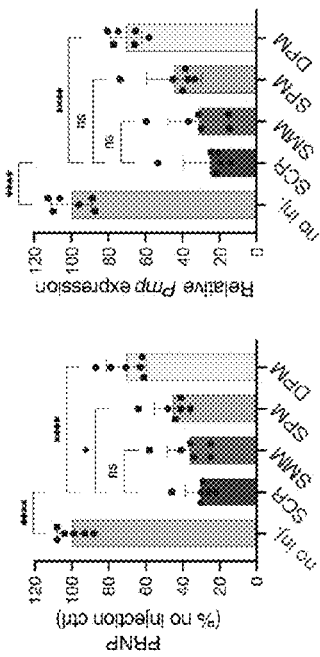
Figure 25B:
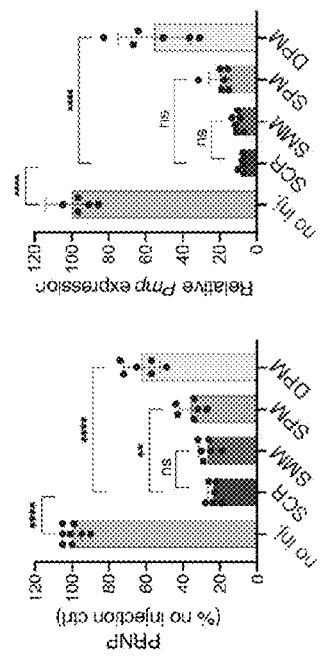
Figure 25E:
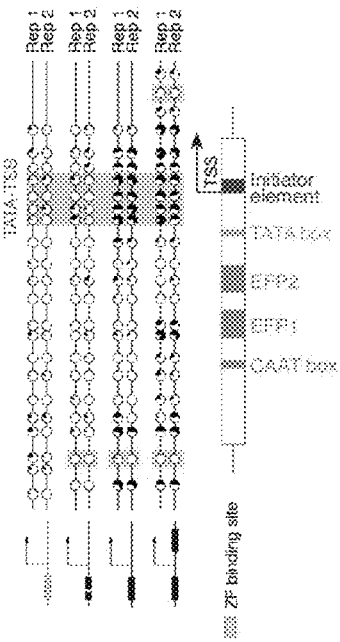
Figure 25D:
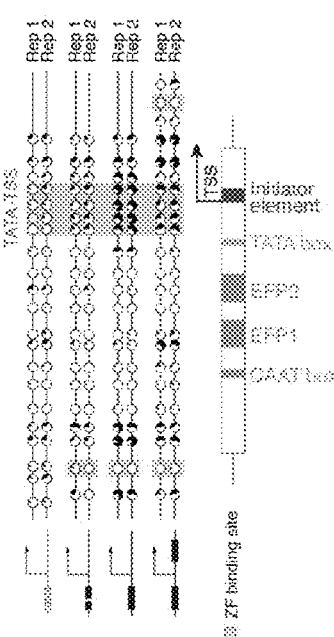

Next, a more modular self-silencing ZFcharm Kv2 was engineered, which eliminates the need to adjust self-silencing kinetics for each new target. To accomplish this, two ZF domains were integrated into a lentiviral construct, with one exclusively responsible for self-silencing and the other for target gene repression (FIG. 22G). To comply with the AAV packaging limit, the construct was optimized to incorporate the Npu intein strategy described above, where a C-terminal N-extein was fused to a CHARM, and an N-terminal C-extein was fused to each ZF (FIGS. 22G & 24A-24C). ZF3, a previously characterized synthetic ZF, was selected for the self-silencing component[21].

inverse relationship between the speed of self-silencing and the degree of Prnp knockdown (FIGS. 25B-25C). Self-silencing ZFcharm constructs lacking the KRAB domain again yielded similar results, arguing that DNA methylation alone is effective in suppressing episomal AAV transgenes in addition to endogenous genes (FIG. 25C).

Figure 26A:
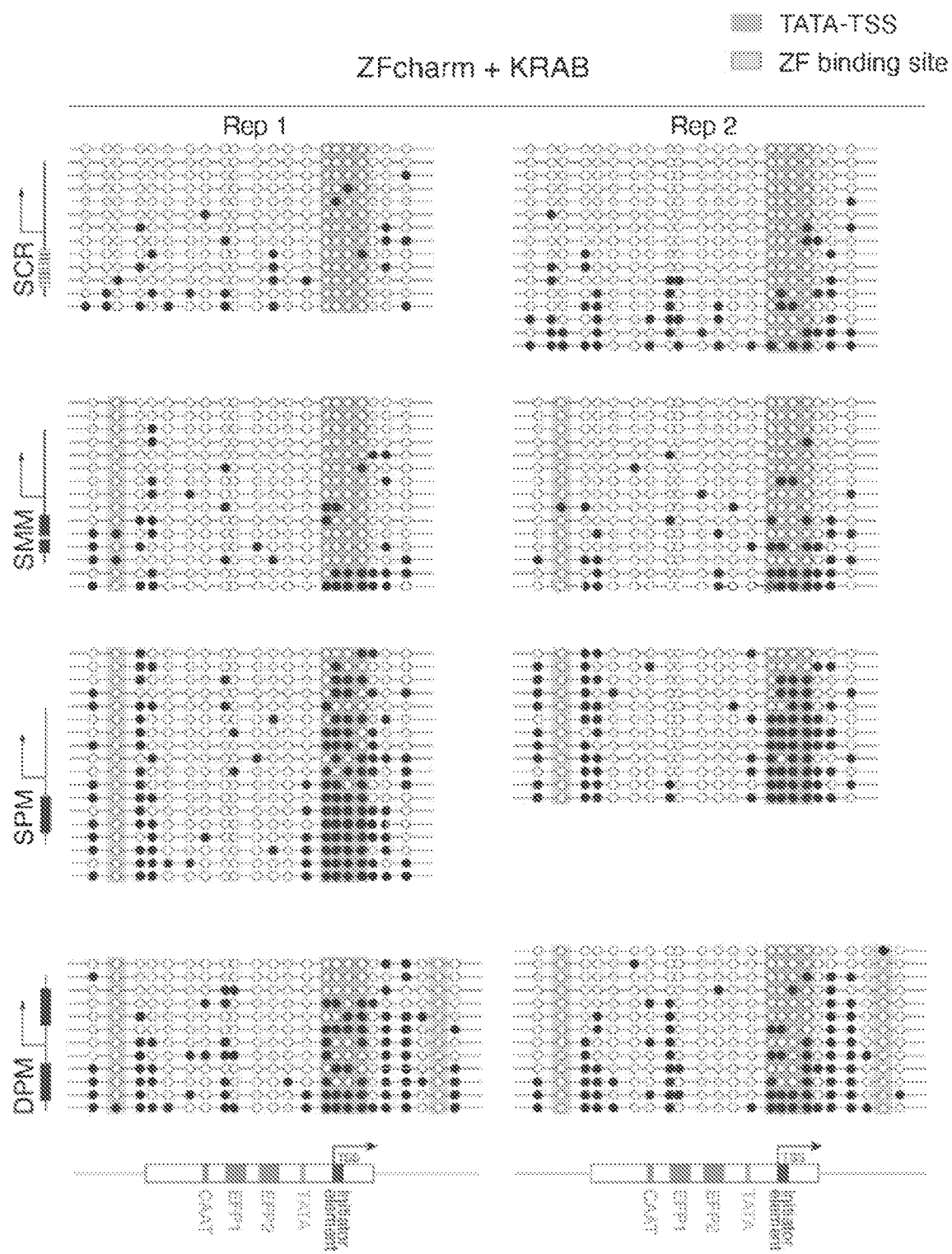
FIGS. 26A-26D Clonal bisulfite sequencing of EFS promoter driving self-silencing ZFcharm constructs in vivo.
Figure 26B:
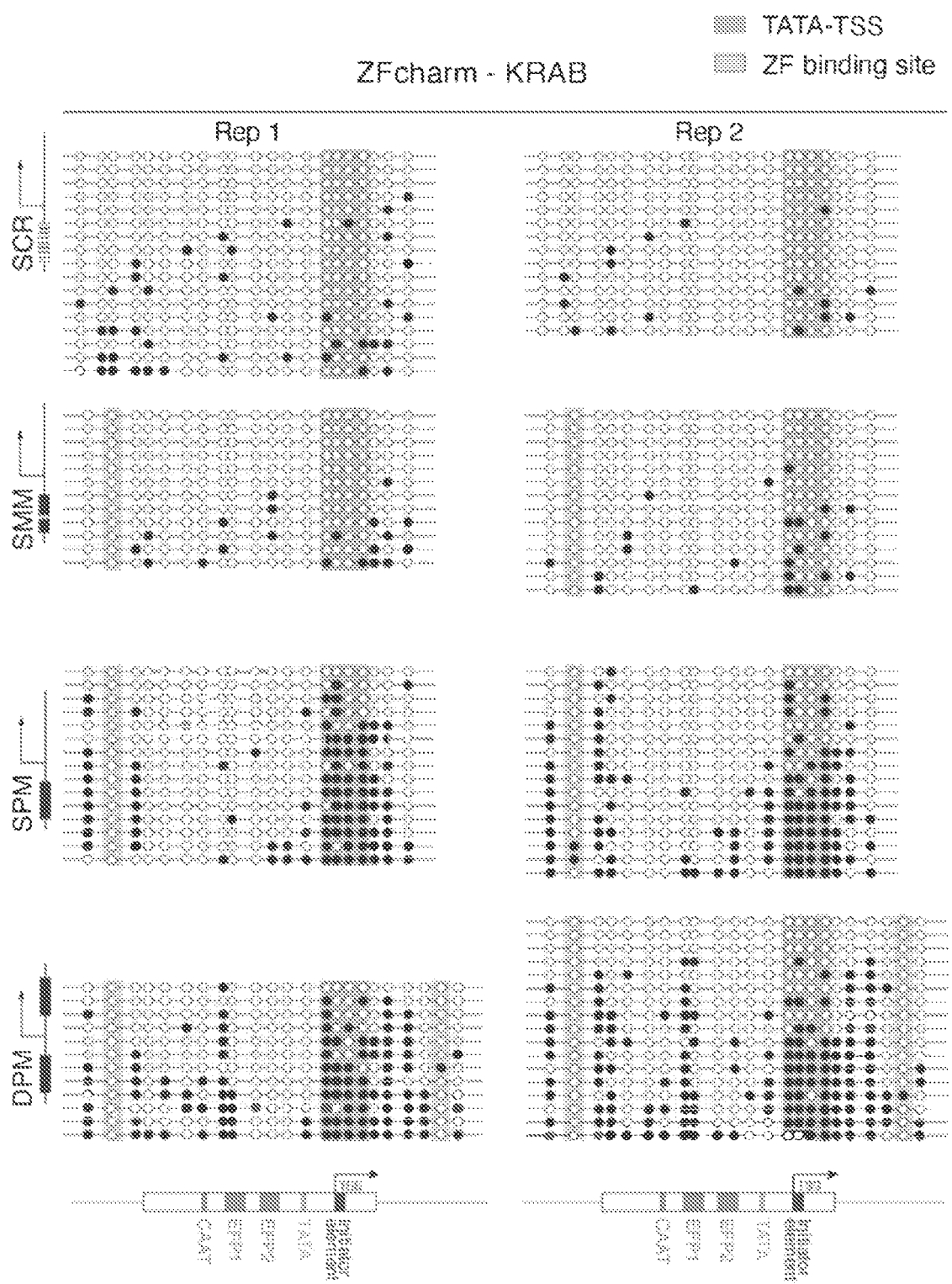
Figure 26C:
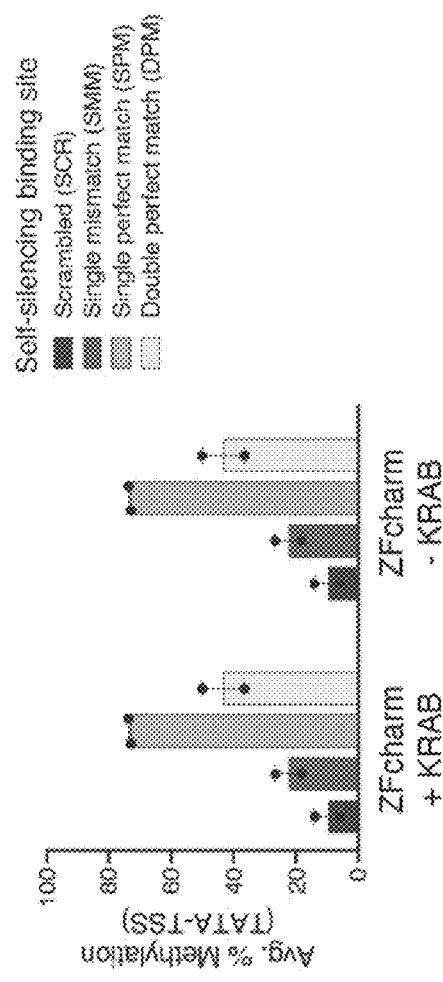
Figure 26D:
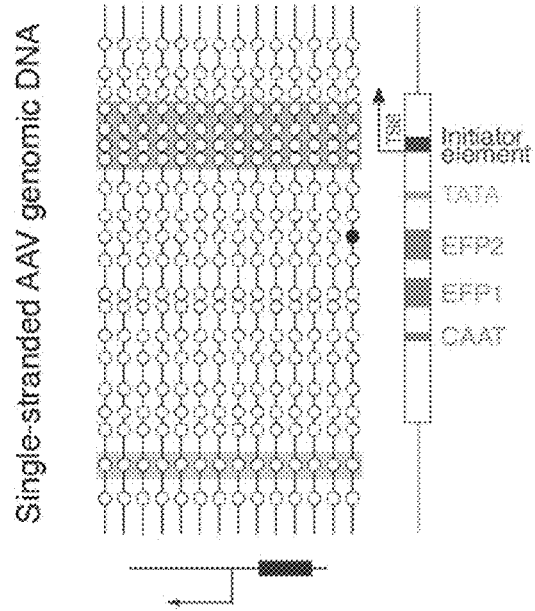

To confirm that a self-silencing CHARM methylates its own promoter in vivo, clonal bisulfite sequencing was performed on episomal AAV DNA extracted from brain homogenate. The SPM and DPM promoters acquired DNA methylation at the CpGs surrounding the TSS and next to the ZF binding site, matching the pattern observed in cultured cells (FIGS. 22D, 25D-25E, & 26A-26C). In contrast, the EFS promoter was completely unmethylated in single-stranded AAV genomic DNA extracted from ZFcharm Kv1-SPM virus, indicating that self-silencing occurred after brain transduction and not during viral packaging (FIG. 26D).

Figure 27A:
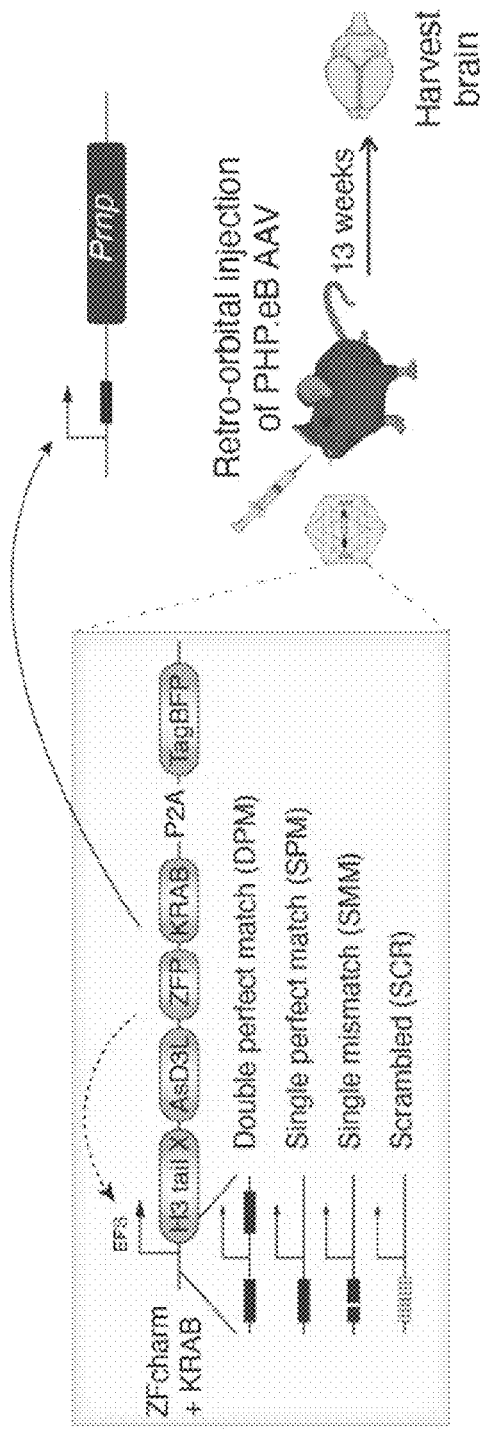
FIGS. 27A-27D Prnp silencing is stable following ZFcharm self-silencing in vivo.
Figure 27D:
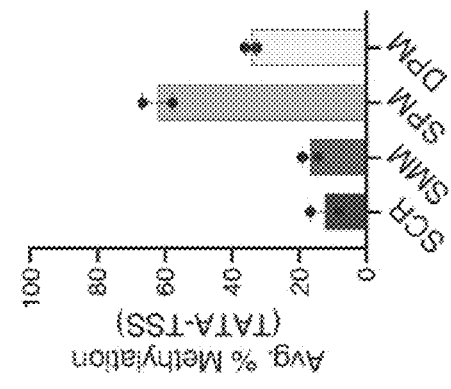
Figure 27B:
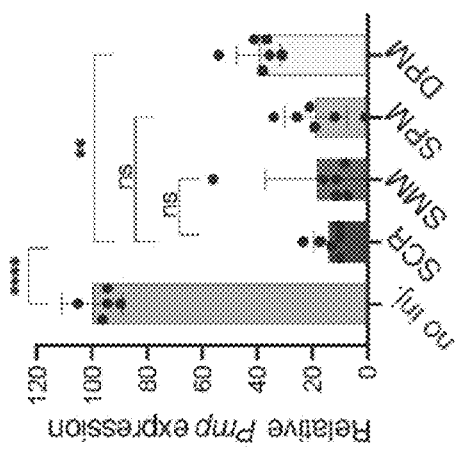
Figure 27C:
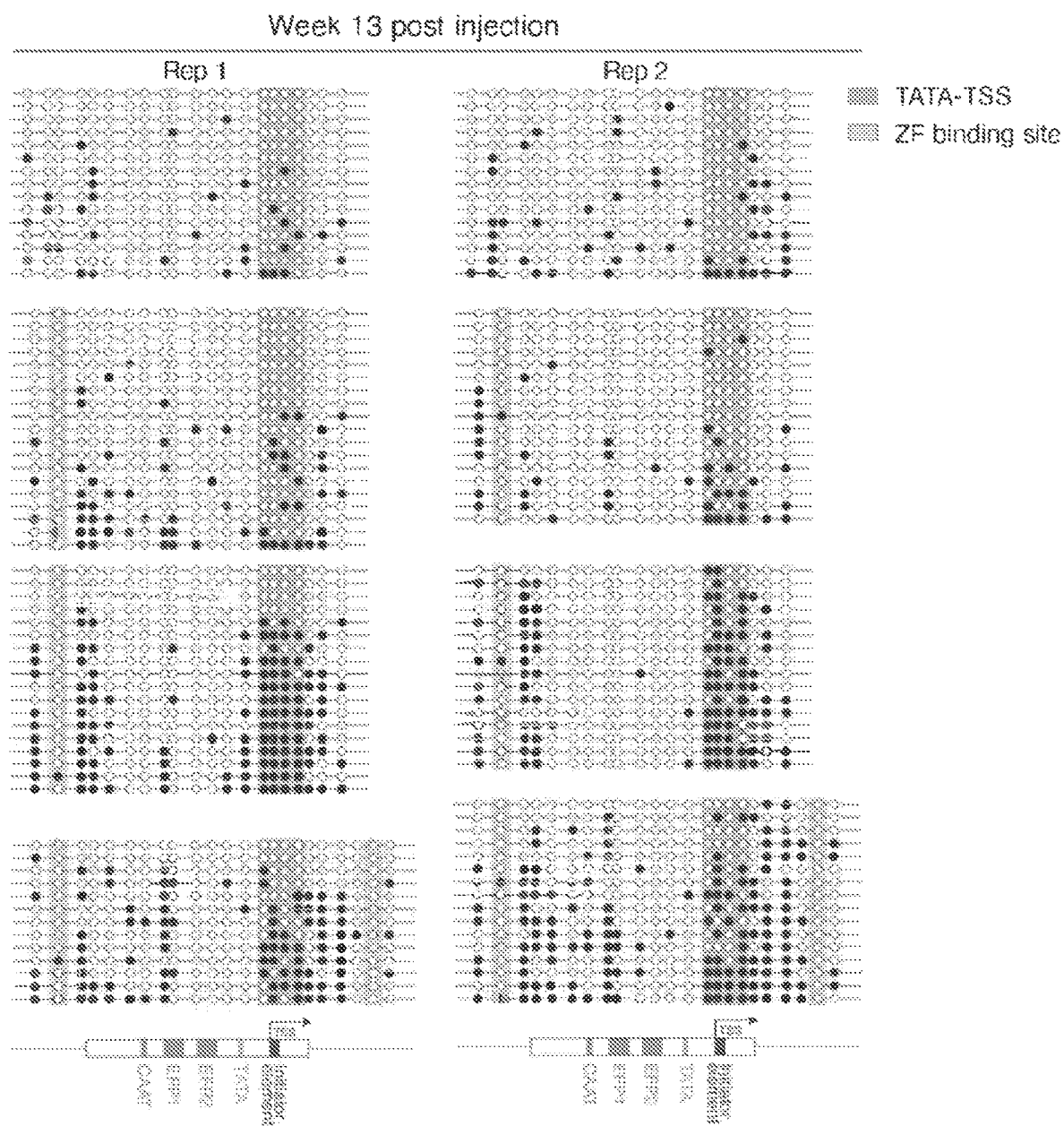
Figure 28A:
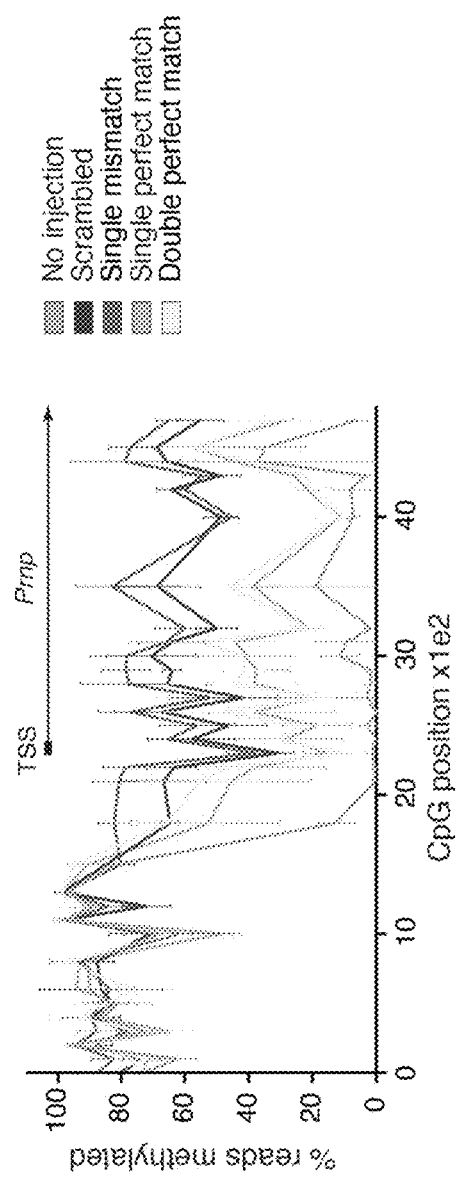
FIGS. 28A-28B Self-silencing ZFcharms methylate the Prnp promoter in vivo.
Figure 28B:
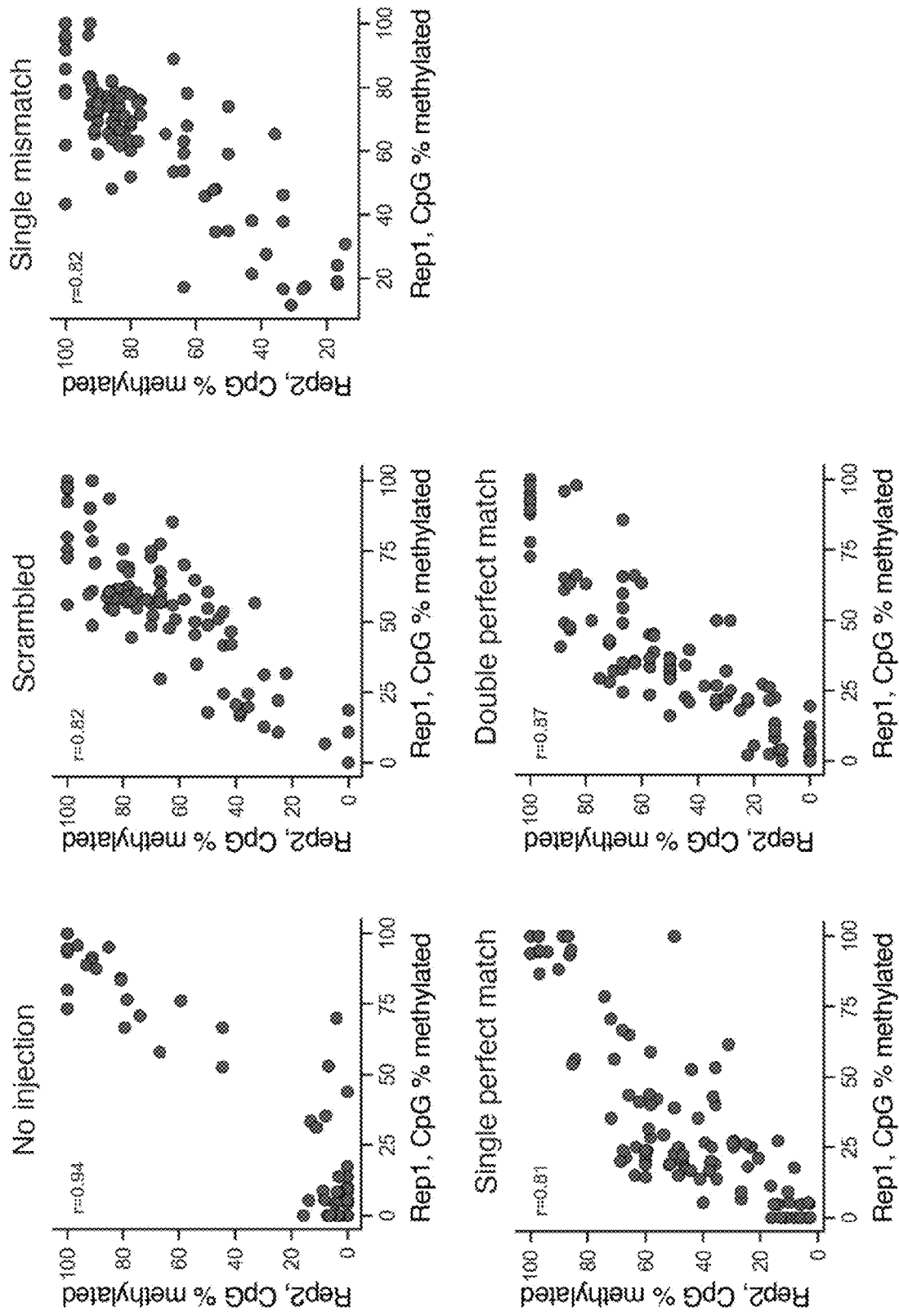

To assess the heritability of Prnp repression following self-silencing in vivo, Prnp expression and AAV promoter methylation were quantified 13 weeks post injection of ZFcharm Kv1-packaged AAV (FIG. 27A). The relationship between self-silencing efficiency and Prnp knockdown persisted, with no evidence of Prnp reactivation (FIGS. 27B-27C). Prnp promoter methylation was consistent with these results (FIGS. 28A-28B), and DNA methylation of the TSS driving ZFcharm expression in the SPM and DPM conditions was also maintained (FIG. 27D). Collectively, the findings indicate that CHARM can be engineered to silence itself in vivo after silencing its target. Additional optimiza-

TABLE 4

ZF3 variants

| Nomenclature | ZF3 backbone variants | Amino Acid Sequence (SEQ ID) | |
|---|---|---|---|
| | | ZF3 | Effector |
| WT | WT | NO: 490 | NO: 498 |
| R6A | R6A | NO: 491 | NO: 499 |
| R15A | R15A | NO: 492 | NO: 500 |
| R100A | R100A | NO: 493 | NO: 501 |
| 2x RtoA | R15A/R100A | NO: 494 | NO: 502 |
| 4x RtoA | R15A/R43A/R100A/R129A | NO: 495 | NO: 503 |
| 6x RtoA | R15A/R43A/R72A/R100A/R129A/R157A | NO: 496 | NO: 504 |
| 7x RtoA | R6A/R15A/R43A/R72A/R100A/R129A/R157A | NO: 497 | NO: 505 |

Figure 22H:
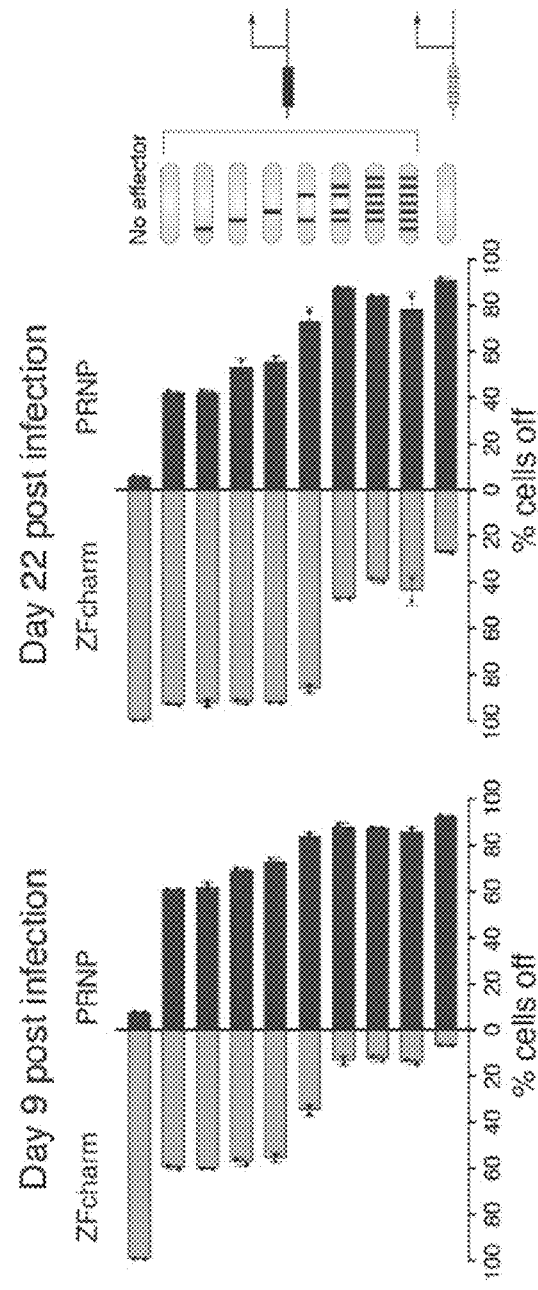
Figure 24A:
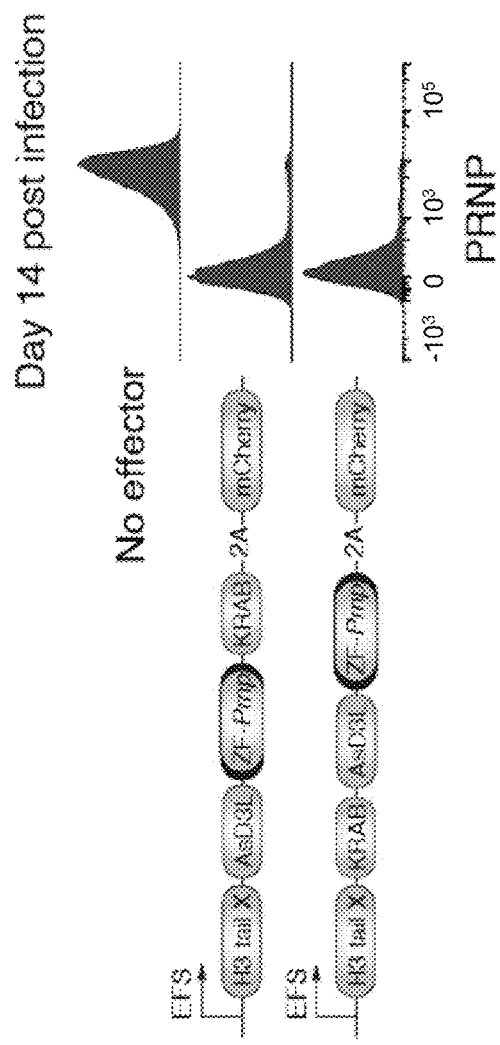
FIGS. 24A-24E Optimization of modular self-silencing ZFcharm construct.
Figure 24B:
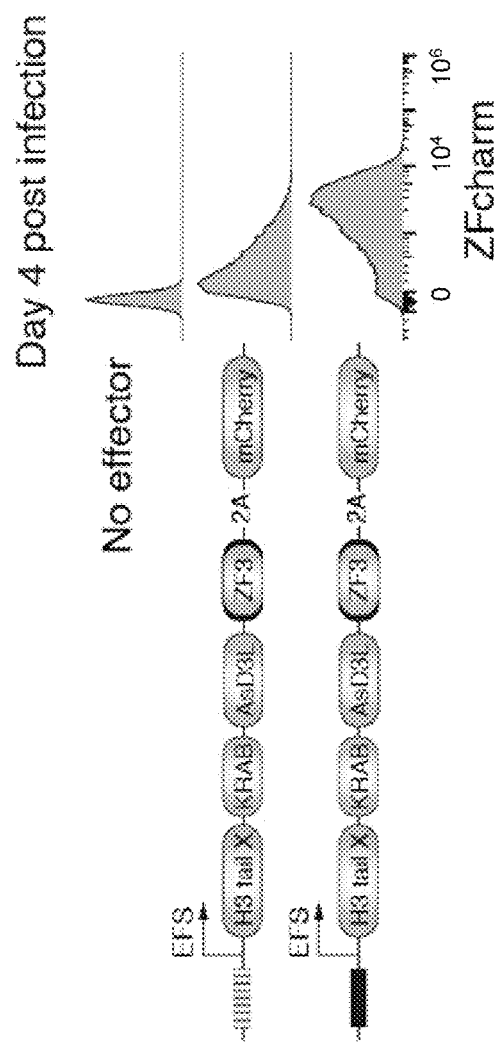
Figure 24C:
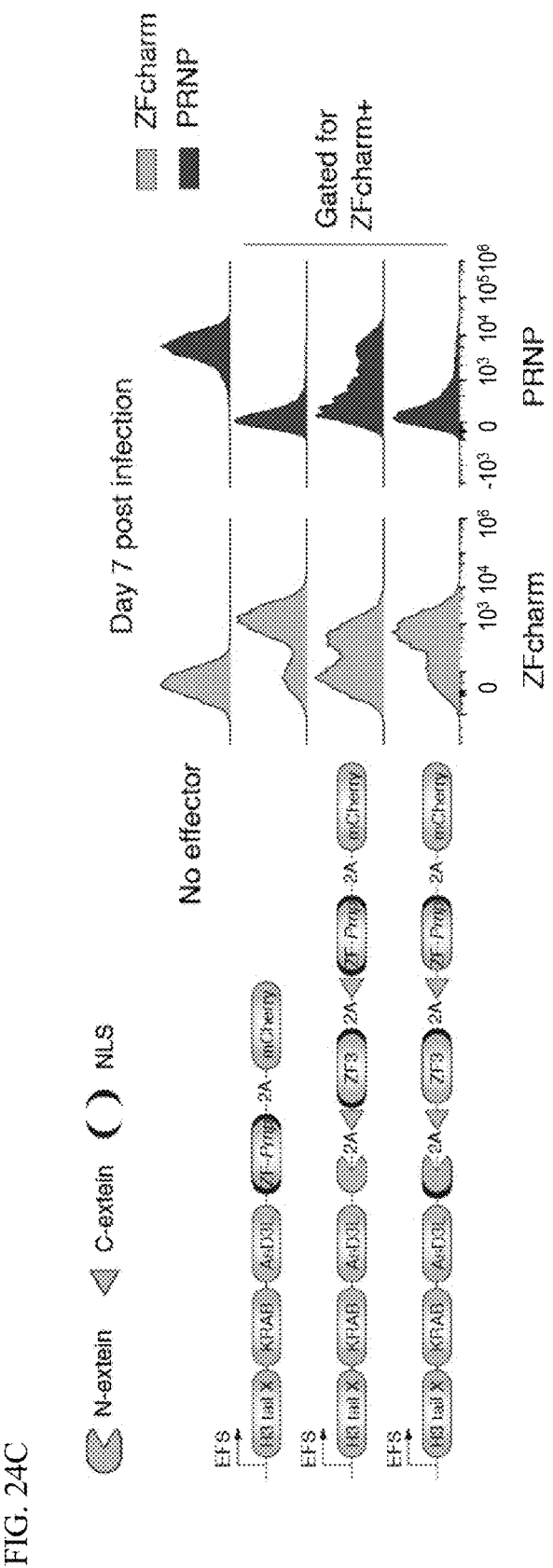
Figure 24D:
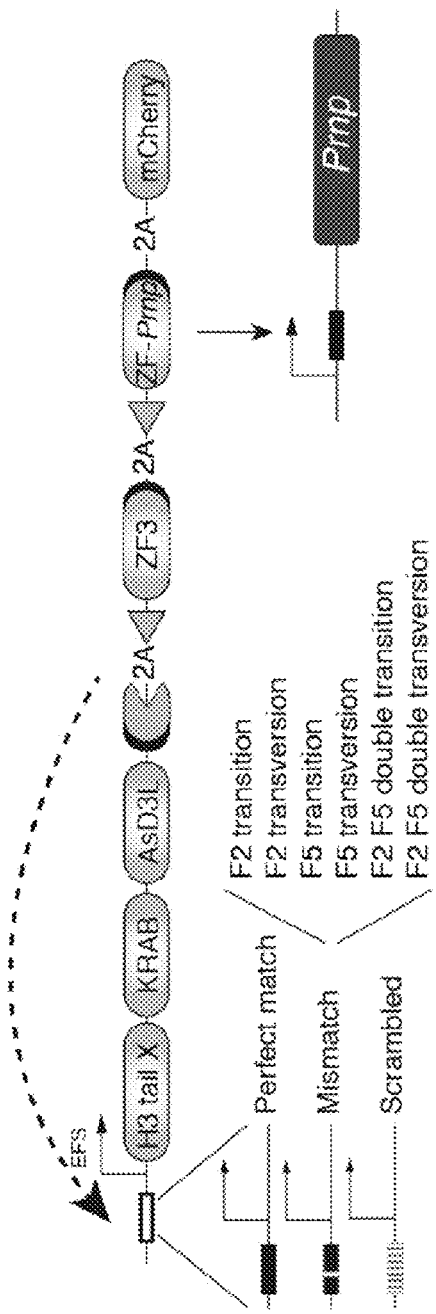
Figure 24E:
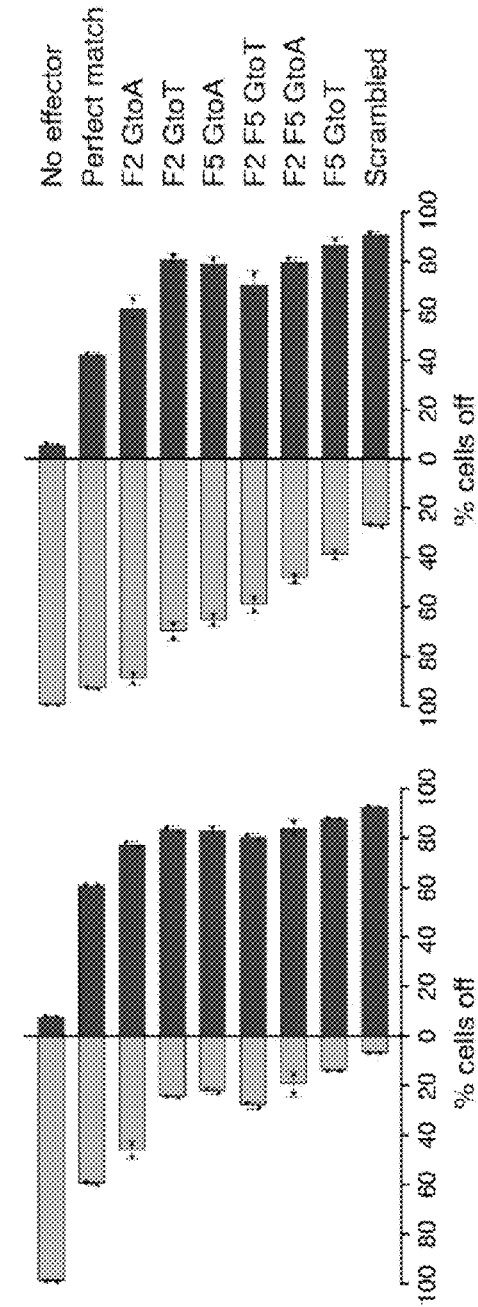

Placing a single ZF3 binding site upstream of the EFS promoter resulted in complete self-silencing and minimal Prnp repression. The kinetics was slowed by cloning an allelic series of arginine-to-alanine (RtoA) mutations in the ZF3 backbone, with the added benefit of reducing off-target interactions[66]. Introducing two RtoA mutations in the ZF3 backbone slowed self-silencing enough for ZF-Prnp to first establish heritable Prnp repression without abrogating self-silencing (FIG. 22H). Point mutations were tested in the ZF3 DNA binding site, illustrating an alternative method to decrease the rate of self-silencing (FIGS. 24D-24E). Together, these results highlight the potential of self-silencing CHARMs to constrain transgene expression when employing delivery modalities which result in sustained cargo expression.

Self-Silencing CHARMs are Functional In Vivo.

AAV capsids were packaged with the same four self-silencing CHARM constructs tested in vitro to assess whether self-silencing approaches work in vivo (FIG. 25A). Prnp expression in the brain was significantly reduced across all conditions 6 weeks post AAV injection, with a clear tion of self-silencing kinetics will further improve the balance between target repression and timely discontinuation of transgene expression, such as by modulating the number of CpG sites in the promoter[67]. For instance, systems for small molecule control of self-silencing, such as tamoxifen-induced nuclear localization of a synthetic ZF transcriptional repressor,[21] could allow for more precise temporal control as well as compatibility with different DNA-binding domains.

The promise of genetic medicines has been limited by the challenges of delivering the large and complex effector complexes (e.g., Cas9-sgRNA ribonucleoproteins) typically required to mediate permanent changes to the genome or epigenome[68]. CHARM is a compact, programmable and readily deliverable DNA methylation system capable of permanently but reversibly[1] silencing targeted genes with high specificity. CHARM leverages the existing cellular machinery thus obviating the need to overexpress any catalytic domain. As such, these effectors are smaller and potentially less cytotoxic than existing technologies and do not rely on DNA sequence edits[69-76]. Unlike genome editing approaches that disrupt coding regions or splice sites, CHARM does not lead to the continued production of an altered mRNA encoding for a truncated protein.

The CHARM system can be readily encoded within the genome of AAV vectors when coupled with ZFPs, TALEs, or small CRISPR-Cas DNA-binding domains. AAV-based delivery has been approved for indications in a variety of tissues including the CNS, muscle, and blood[77]. ZFcharm represents the first AAV-delivered tool capable of gene silencing through targeted DNA methylation. Specifically, the mouse data show that the CHARM system can establish stable DNA methylation and transcriptional silencing of the prion protein in the large majority of neurons, a post-mitotic cell type, which argues for its utility in preventing other neurodegenerative diseases caused by a buildup of toxic protein aggregates[35,36]. The small size of ZFcharm enables a range of strategies for optimizing delivery and efficacy, which is illustrated by developing modular and tunable self-silencing ZFcharms. This can be extended to multiplexed targeting using up to three distinct ZFcharms or the use of different promoters or 3'UTRs that drive robust cell-type specific expression. The major components of ZFcharm are either derived from or closely related to human proteins, so it is expected to have reduced antigenic propensity especially in the context of time-limited expression.

The dominant mechanism of FDA-approved drugs is through inhibition of a target protein[78]. Thus, while major challenges remain, long-term and reversible gene silencing is potentially applicable to prevent or treat a range of pathological processes. Additionally, silencing enhancers[1] could enable cell type-specific tuning of gene expression, and the relatively wide targeting window of epigenetic silencers facilitates the use of single nucleotide polymorphisms for allele-specific targeting. A wide variety of AAV capsid variants are in development with tropism for different tissues[79,80], including a recently-described engineered AAV capsid that can be injected systemically and cross the blood-brain barrier for human CNS delivery[81]. Beyond AAVs, the compact and single-component nature of ZFcharm could greatly facilitate other delivery platforms. For example, the short mRNA of ZFcharm could be delivered by engineered virus-like particles or lipid nanoparticles (LNP)[68, 82-84] without the need for co-delivery of guide RNAs and difficult-to-produce long mRNAs.

Prion diseases represent a promising area for the initial clinical development of AAV-delivered ZFcharms. These diseases are currently untreatable and lead to rapid decline and death. Animal studies provide a strong rationale for the therapeutic targeting of the prion protein. Even after onset of symptoms, moderate decreases of PRNP expression in neurons is sufficient to halt and even reverse the disease process, while complete inhibition of PRNP expression is well tolerated across the number of mammalian species explored[27-31]. The demonstration of 80% knockdown of PRNP expression far exceeds the minimal knockdown required for a therapeutic effect—ASO mediated repression as little as 25% was sufficient to delay the onset of symptoms and extend survival with five different prion strains[85]. Finally, both the mouse and human PRNP genes can be readily and stably silenced, and homology between the PRNP promoter in humans and nonhuman primates could enable the design of cross-reactive ZFcharms for preclinical studies. Beyond the potential in treating prion diseases, therapeutic targeting of PRNP will also provide practical experience on the benefits and unforeseen challenges of broader clinical applications of CHARM.

To summarize, prion diseases are caused by misfolding of the prion protein (PRNP) into pathogenic self-propagating conformations, leading to rapid onset dementia and death. However, elimination of endogenous PRNP can halt prion disease progression. Here, CHARM (Coupled Histone tail for Autoinhibition Release of Methyltransferase), a compact, enzyme-free epigenetic editor capable of silencing transcription through programmable targeted DNA methylation, is described. Using a histone H3 tail fusion, CHARM recruits and activates the endogenous DNA methyltransferases, thereby reducing transgene size and bystander effects. When delivered to the mouse brain by an adeno-associated viral (AAV) vector, PRNP-targeted CHARM ablates prion expression in neurons. Expression of the editor was temporally limited by implementing a kinetically-tuned self-silencing approach. CHARM represents a broadly applicable strategy to programmably reduce (e.g., prevent) expression of pathogenic proteins, including those implicated in other neurodegenerative diseases.

Materials and Methods

Cell Culture and Cell Line Generation

HEK293T (ATCC, CRL-3216) and Neuro-2a (N2a; ATCC, CCL-131) cells were cultured in Dulbecco's Modified Eagle Medium (DMEM) supplemented with 10% fetal bovine serum (FBS), 100 units/mL streptomycin, 100 µg/ml penicillin, and 2 mM glutamine. Cells were passaged every 2 to 3 days using Trypsin-EDTA (0.25%). Cell lines were cultured at 37° C. with 5% $CO_2$.

The mScarlet-CLTA cell line was generated by knocking in a 5' mScarlet tag at the CLTA locus. The sgRNA sequence targeting CLTA was ligated into pX458 (Addgene #48138) to generate the Cas9+sgRNA plasmid. A double-cut HDR donor plasmid with the mScarlet tag sequence flanked by 800 bp homology arms was cloned from a pUC19 backgone (Addgene #50005) using NEBuilder HiFi DNA Assembly (New England BioLabs, E2621L). Knock-in efficiency was increased by flanking the donor sequence with sgRNA-PAM sequences to induce linearization post transfection[86]. The HDR donor and Cas9+sgRNA plasmids were co-transfected into HEK293T cells using TransIT-LT1 Transfection Reagent (Mirus Bio, 10767-122). mScarlet+ cells were sorted by FACS 6 days post transfection and successful tag insertion was validated via PCR.

Plasmid Design

Guide RNAs were designed using CRISPick SpCas9 CRISPRi guide prediction software[88]. The sgRNA-expressing lentiviral vectors were constructed by ligation of annealed oligonucleotides (IDT) downstream of an EF-1 alpha promoter using BstXI and BlpI restriction sites. The vector also expresses HaloTag7 to allow for transfection and infection rate measurement by staining with Janelia Fluor HaloTag Ligands (Promega, GA1110). Cloning AAV plasmids and CHARM constructs was performed with eBlocks DNA fragments (IDT), oligonucleotides (IDT), or PCR amplicons produced from appropriate template sequences using Q5 Hot Start High-Fidelity 2× Master Mix (New England BioLabs, M0494L) or KOD Xtreme Hot Start DNA Polymerase (EMD Millipore, 719753). DNA fragments were cloned into restriction enzyme-digested plasmids using NEBuilder HiFi DNA Assembly (New England BioLabs, E2621L). All plasmids were sequence-confirmed by long-read whole plasmid sequencing.

Plasmid Transfection

Transient transfection experiments in N2a cells were performed in 6-well plates using TransIT-LT1 Transfection Reagent (Mirus Bio, 10767-122) and Opti-MEM Reduced Serum Medium (Thermo Fisher Scientific, 31985062). Cells at 70% confluency were transfected with 2.5 μg of plasmid. Cells co-transfected with plasmid encoding CRISPRoff or CRISPRi and plasmid encoding sgRNA were transfected with 1.7 μg and 800 ng, respectively. Transient transfection experiments in HEK293T cells were performed in 24-well plates using polyethylenimine (PEI). Cells at 70% confluency were transfected with 250 ng of plasmid. Transfected cells were sorted on TagBFP expression 2 days post transfection on a SONY MA900 and re-plated at a density of 120K cells/well in a 24-well plate. Cells were given four days to recover without changing media. Beginning at six days post-transfection, cells were assessed for fluorescence markers using the Attune NxT Flow Cytometer and passaged at a 1:8 dilution every two days for the duration of the time course.

Lentiviral Packaging and Transduction

Lentiviral particles were produced by co-transfecting lentiviral transfer plasmids with standard packaging vectors psPAX2 (Addgene #12260) and pMD2.G (Addgene #12259) into HEK293T using FuGENE HD (Promega, PAE2311) or PEI. Media was replaced with fresh media supplemented with ViralBoost (Alstem, NC0966705) 6 hours post-transfection. Viral supernatants were harvested 48 hours after transfection and flash-frozen. Lentiviral transductions were performed in polybrene-supplemented media (8 μg/ml). Media was replaced the following day and selection with 2 μg/mL puromycin was initiated two days post transduction.

PiggyBac Transfection

The Super PiggyBac Transposase Expression Vector (System Biosciences, PB210PA-1) and CHARM-expressing PiggyBac transposon vector were co-transfected at a 1:10 molar ratio into N2a cells using TransIT-LT1 Transfection Reagent (Mirus Bio, 10767-122). Selection with 2 μg/mL puromycin was initiated 2 days post transfection. Cells were assessed for ZFcharm Kv1 and PrP expression using immunofluorescence staining (see below) followed by flow cytometry using the Attune NxT Flow Cytometer.

Immunofluorescence Staining

Staining for cell surface proteins PrP, CD51, CD81, and CD151 was performed on cells at 50-90% confluency in 24-well plates. Cells were resuspended in PBS using mechanical force and transferred to a 96-well V-bottom plate. Cells were incubated at 4° C. in the dark for 30 minutes with the appropriate fluorophore-conjugated antibody (Alexa Fluor 647 anti-CD230, Biolegend, 808007; APC anti-human CD81, Biolegend, 349509; APC anti-human CD55, Biolegend, 311311; APC anti-human CD151, Biolegend, 350405) at a concentration of 0.5 μg/mL. Cells were washed twice in PBS supplemented with 5% FBS and read out on the Attune NxT Flow Cytometer.

Cell Viability Staining

To assess cytotoxicity of the different epi-editors, HEK293T cells were transiently transfected with ZFP constructs followed by FACS on TagBFP expression two days later. After recovering from FACS for four days, 1e6 cells were trypsinized, spun down at 400×g for 5 minutes, and resuspended in 1 mL of PBS. One L of LIVE/DEAD™ Fixable Near-IR Dead Cell Stain for 633 or 635 nm excitation (Invitrogen™ L34975) dissolved in DMSO was added to the cells and kept on ice for 30 minutes protected from light. Cells were pelleted and washed with PBS twice followed by resuspension in 150 μL of PBS and flow cytometry on the Attune NxT Flow Cytometer. Total viable cells per 100 μL were counted based on near-IR (~780 nm) fluorescence.

DNMT3L Phylogeny Construction

Genome-mining for DNMT3L orthologs and ancestral reconstructions was performed based on previously established methods[6]. A list of ~200 DNMT3L orthologs was obtained by performing a BLASTP[89] search in the NCBI non-redundant protein sequences database, using the human and mouse DNMT3L amino acid sequences as a query, and removing sequences with ≥97% pairwise identity. A MAFFT multiple sequence alignment was performed using the FFT-NS-i (standard) strategy with a maximum of two iterations[90] and then used for phylogenetic tree construction implementing IQ-TREE software[91]. With IQ-TREE we inferred the phylogenetic tree using the predicted best-fit model and ultrafast bootstrapping with 1000 replicates and optimized parameters. After visualization of the tree using the interactive tree of life (iTOL) v5 online tool[92], selected ancestral nodes were predicted with the IQ-TREE ASR function[91]. Two dozen GenScript codon-optimized orthologs and ASRs were synthesized as DNA eBlocks (IDT).

TALE Design

TALE DNA-binding domains were constructed following published guidelines[86,87]. In brief, potential 18-nucleotide binding sites beginning with the invariable thymine were compiled from the mouse and human PRNP promoter regions and scored for specificity using nucleotide BLAST[89]. Top candidates were selected for synthesis in the chimerized TALE scaffold[55] using the following repeat variable diresidues (RVDs): HD for cytosine, NG for thymine, NI for adenine, NH for guanine, and G* for any possible 5-methyl-cytosine within a CpG dinucleotide. Each TALE was synthesized as eBlocks (IDT) in two halves which were cloned into a CHARM acceptor vector using NEBuilder HiFi DNA Assembly (New England BioLabs, E2621L).

Extraction of HMW gDNA

To extract high molecular weight (HMW) genomic DNA (gDNA) from cells for Nanopore long-read sequencing analysis, 1e6 cells were pelleted at 400×g for 5 minutes, rinsed with PBS, and pelleted again. Pellets were processed using the Monarch® HMW DNA Extraction Kit for Cells & Blood (New England Biolabs, T3050L). To extract HMW gDNA from mouse brain tissue, two 150 μm coronal sections were cut from flash-frozen hemispheres embedded in optimal cutting temperature (O.C.T.) compound (see below) and collected in a single 1.5 mL Eppendorf tube. These were frozen at −80° C. until ready for preparation. Prior to processing using the Monarch® HMW DNA Extraction Kit for Tissue (New England Biolabs, T3060L), these sections were rinsed with ice-cold PBS twice and pelleted on a tabletop microcentrifuge (MyFuge 12 Mini Centrifuge, Benchmark Scientific C1012) to remove excess O.C.T. The gDNA extraction was performed following manufacturer instructions with slight modifications to maximize yield; three glass beads were used instead of two, and gDNA was eluted in 200 μL of water heated to 65° C. To concentrate the gDNA for Nanopore library preparation (to ~5 μg DNA in <24 μL), gDNA in the eluate was precipitated by adding 2 μL 20 mg/mL glycogen (Thermo Scientific, R0561), 22 μL 3M pH 5.2 sodium acetate, and 155 μL pure room temperature isopropanol followed by mixing and centrifugation at 15,000×g for 20 minutes at 4° C. Supernatant was carefully decanted and DNA pellets were washed with 1 mL 70% ethanol and centrifuged at 15,000×g again for 10 minutes at 4° C. Supernatant was decanted and the pellet was air-dried for 10 minutes. The DNA pellet was redissolved in 25 μL water at 56° C. for two hours. Wide-bore pipette tips (Genesee Scientific, 22-427 and 22-424) were used for all gDNA handling steps to prevent shearing.

Target Enrichment and Nanopore Library Preparation

Two upstream and two downstream guide RNAs were designed flanking the PRNP locus in a ~5 kb window using CHOPCHOPv3[93]. Alt-R® CRISPR-Cas9 tracrRNA (IDT, 1072533) and custom Alt-R® CRISPR-Cas9 crRNA (IDT) were annealed at 10 μM in nuclease-free duplex buffer (IDT, 11-01-03-01). In a 1.5 mL Eppendorf tube, 79.2 μL of water was combined with 10 μL of reaction buffer (RB) from the Cas9 Sequence Kit Cas9 Sequencing Kit (Oxford Nanopore Technologies, SQK-CS9109), 10 μL of 10 μM pooled annealed guide RNAs, and 0.8 μL of 62 μM Cas9 nuclease (Alt-R™ S.p. HiFi Cas9 Nuclease V3, IDT 1081060) and was complexed at room temperature for 30 minutes before use. Prior to Nanopore sequencing of native DNA molecules, the prion locus was enriched using 5 μg of input gDNA and prepared for sequencing following manufacturer's protocols (ONT, SQK-CS9109).

RNA-Sequencing

N2a cells were maintained for 28 days post lentiviral transduction of ZFcharm Kv1 and CRISPRcharm Kv1 constructs. CISPRcharm Kv1 was introduced into cells constitutively expressing either a non-targeting sgRNA or a sgRNA targeting Prnp. Each transduction was done in triplicate. Cells were dislodged from 6-well plates using Trizol and total RNA was extracted using the Direct-zol RNA Miniprep Kit (Zymo, R2051). Libraries were prepared using the KAPA RNA HyperPrep Kit with RiboErase (HMR) (Roche, KK8560) and sequenced as 50 bp single-end reads on a NovaSeq SP (Illumina). Raw sequencing reads were aligned to the mouse genome (mm39) using STAR 2.7.1a and quantified using featureCounts[94]. Differential expression analysis was carried out using DESeq2[95].

Clonal Bisulfite Sequencing

Clonal bisulfite sequencing of the EFS promoter was performed on (1) genomic DNA extracted from lentivirally transduced N2a cells, (2) double-stranded AAV genomes extracted from brain homogenate, and (3) single-stranded AAV genomes extracted from viral particles. N2a genomic DNA was extracted using the PureLink Genomic DNA Mini Kit (Invitrogen, K182001). AAV episomal DNA was obtained via Trizol-Chloroform extraction from brain homogenate followed by treatment with T5 exonuclease (New England BioLabs, M0663S) and RNase Cocktail Enzyme Mix (Thermo Fisher Scientific, AM2288). To extract single-stranded AAV DNA, viral particles were treated with Turbonuclease (MilliporeSigma, T4330) to digest contaminating plasmid DNA and then with Proteinase K to digest viral capsids. Both double- and single-stranded AAV DNA was purified with the DNA Clean & Concentrator-5 Kit (Zymo, 11-302B). Bisulfite conversion was performed on 100-500 ng DNA using the EZ DNA Methylation Lightning Kit (Zymo, D5001). Purified bisulfite-converted DNA was amplified with forward primer GAGTGGTTAATTTTATT-ATTAGGGGT (5' to 3') and reverse primer TTTCTAACAATTTATTTAATCCTAACCA (5' to 3') using EpiMark Hot Start Taq (New England BioLabs, M0490S), and purified using a QIAquick PCR Purification Kit (QIAGEN, 28104). Amplicons were cloned into pCR2.1-TOPO Vector using a TOPO TA Cloning Kit (Invitrogen, 451641) and transformed into Stellar Competent E. coli Cells (Takara Bio, 636766). Cells were plated on plates supplemented with carbenicillin, X-gal, and IPTG for blue-white screening. Colonies were sequenced by Sanger sequencing and reads were processed for display using QUMA software[96].

AAV Production and Titering

Recombinant AAVs (AAV-PHP.eB) were produced in suspension HEK293T cells, using F17 media (Thermofisher, A138501). Cell suspensions were incubated at 37° C., 8% $CO_2$, 80 RPM. 24 hours before transfection, cells were seeded in 500-1000 mL at ~1 million cells/mL. The day after, cells (~2 million cells/mL) were transfected with pHelper, pRepCap, and pTransgene (2:1:1 ratio, 2 μg total DNA per million cells) using Transport 5 transfection reagent (Polysciences, 26008-50) with a 2:1 PEI:DNA ratio. Three days post-transfection, cells were pelleted at 2000 RPM for 12 minutes into Nalgene conical bottles. The supernatant was discarded, and cell pellets were stored at −20° C. until purification. Each pellet, corresponding to 500 mL of cell culture, was resuspended in 14 mL of 500 mM NaCl, 40 mM Tris-base, 10 mM $MgCl_2$, with Salt Active Nuclease (ArcticZymes, #70920-202) at 100 U/mL. Afterwards, the lysate was clarified at 5000 RCF for 20 minutes and loaded onto a density step gradient containing OptiPrep (Cosmo Bio, AXS-1114542) at 60%, 40%, 25%, and 15% at a volume of 6, 6, 8, and 5 mL, respectively, in OptiSeal tubes (Beckman, 342414). The step gradients were spun in a Beckman Type 70ti rotor (Beckman, 337922) in a Sorvall WX+ ultracentrifuge (Thermo Scientific, 75000090) at 67,000 RPM for 75 minutes at 18° C. Afterwards, ~4.5 mL of the 40-60% interface was extracted using a 16-gauge needle, filtered through a 0.22 μm PES filter, buffer exchanged with 100K MWCO protein concentrators (Thermo Scientific, 88532) into PBS containing 0.001% Pluronic F-68, and concentrated down to a volume of 200-1000 μL. The concentrated virus was filtered through a 0.22 μm PES filter and stored at 4° C. or −80° C.

To determine AAV titers, 5 μL of each purified virus library was incubated with 100 μL of an endonuclease cocktail consisting of 1000U/mL Turbonuclease (Sigma T4330-50KU) with 1× DNase I reaction buffer (New England BioLabs, B0303S) in UltraPure DNase/RNase-Free distilled water at 37° C. for one hour. Next, the endonuclease solution was inactivated by adding 5 μL of 0.5 M EDTA, pH 8.0 (ThermoFisher Scientific, 15575020) and incubated at room temperature for 5 minutes and then at 70° C. for 10 minutes. To release the encapsidated AAV genomes, 120 μL of a Proteinase K cocktail consisting of 1 M NaCl, 1% N-lauroylsarcosine, 100 μg/mL Proteinase K (QIAGEN, 19131) in UltraPure DNase/RNase-Free distilled water was added to the mixture and incubated at 56° C. for 2-16 hours. The Proteinase K-treated samples were then heat-inactivated at 95° C. for 10 minutes. The released AAV genomes were serial diluted between 460-4,600,000× in dilution buffer consisting of 10× PCR Buffer (Thermo Fisher Scientific, N8080129), 2 μg/mL sheared salmon sperm DNA (Thermo Fisher Scientific, AM9680), and 0.05% Pluronic F68 (Thermo Fisher Scientific, 24040032) in UltraPure Water (Thermo Fisher Scientific). 2 μL of the diluted samples were used as input in a ddPCR supermix (Bio-Rad, 1863023). Primers and probes, targeting the ITR region, were used for titration at a final concentration of 900 nM and 250 nM (ITR2_Forward: 5'-GGAACCCCTAGTGATGGAGTT-3'; ITR2_Reverse: 5'-CGGCCTCAGTGAGCGA-3'). The droplets were transferred to the thermocycler and cycled according to the manufacturer's protocol with an annealing/extension of 58° C. for one minute. Finally, droplets were read on a QX100 Droplet Digital System to determine titers.

Mice

All in vivo experiments were approved by the Institutional Animal Care and Use Committee of the Broad Institute (Protocol #0162-05-16-2, most recent approval date:

2023-01-03) and were performed in accordance with the National Institutes of Health Guidefor the Care and Use of Laboratory Animals. Experiments in this study used 192 C57BL/6N mice (90 female, 102 male) obtained from Charles River Laboratories. Unless otherwise noted, mice were between 5-8 weeks old at the time of AAV injections.
Intravenous AAV Injection Mice were anesthetized using inhaled isoflurane at 1-3%. AAV vectors (1.5e13 vg/kg, ~100 ml injection volume) were administered intravenously into the right retro-orbital sinus of the animal using a 300 µL insulin syringe with a 31G needle (328438, Becton Dickinson, USA). One drop of 0.5% proparacaine (07-892-9554, Patterson Veterinary, USA) was applied topically to the eye immediately following injection. Mice were euthanized using $CO_2$ inhalation at timepoints of 6- or 12-weeks post-injection, following which the brains were harvested and cut in half. One hemisphere was placed in a microtube and flash-frozen on dry ice for biochemical analysis, while the other hemisphere was prepared for histological analysis. In brief, a small amount of optimal cutting temperature (OCT) compound (Tissue-Tek 4583, Sakura, USA) was placed into a 15×15×5 mm cryomold (Tissue-Tek 4566, Sakura, USA), the hemisphere was placed cut side down into the mold, and fully covered with additional OCT compound prior to being flash-frozen on dry ice. All samples were stored at −80C until further processing.
Mouse Perfusions Mice were deeply anesthetized under 2-5% isoflurane and 0.5-1 LPM oxygen in an induction chamber. Mice were then transferred to a nose cone providing 2-5% isoflurane and 0.5-1 LPM oxygen. Anesthesia depth was validated with lack of bilateral toe pinch prior to the start of the surgical procedure. Mice were continuously monitored throughout the procedure for any signs of responsiveness. Paw color and respiration rate were monitored at all times during anesthesia. Once anesthesia was stable and at an acceptable plane for surgery (based on lack of a toe-pinch and eye blink response, and stable slow respiratory rate), an incision was made through the skin below the ribcage and blunt dissection scissors were used to separate the outer layers of skin from the cavity wall. A mid-sternal thoracotomy was then performed to expose the heart and great vessels. Perfusate was delivered using a needle through the left ventricle and an incision was made in the right atrium to provide an outflow for blood and perfused fluids.

Perfusion was carried out with ice-cold saline solution followed by phosphate buffered saline containing 4% paraformaldehdye (PFA). Perfusion was complete when outflow perfusate showed no visual trace of blood, and the animal had no cardiac or respiratory activity. Mice were decapitated prior to brain dissection.
Brain Homogenization One hemisphere was homogenized at 10% wt/vol in cold 0.2% CHAPS solution prepared in 1×PBS with 1 tablet protease inhibitor (Roche cOmplete 4693159001, Millipore Sigma, USA) per 10 mL in 7 mL tubes pre-loaded with zirconium oxide beads (Precellys, Bertin, USA), using 3×40 second pulses on a Bertin MiniLysis Homogenizer (Bertin, USA). Homogenate was aliquoted into 40 µL aliquots for protein analysis and 300 µL aliquots for qPCR analysis and stored at −80° C. until further analysis.
Protein Analysis PrP concentration in the brain was quantified using a previously published PrP ELISA (Mortberg et al., Regional variability and genotypic and pharmacodynamic effects on PrP concentration in the CNS, JCI Insight 7(6):e156532 (2022)). Briefly, the assay uses EP1802Y antibody (ab52604, Abcam, USA) for capture and biotinylated 8H4 antibody (ab61409, Abcam, USA) for detection, with streptavidin-HRP (Pierce High Sensitivity, 21130, Thermo Fisher Scientific, USA) and TMB substrate (7004P4, Cell Signaling Technology, USA). Recombinant mouse PrP (Mo-PrP23-231) prepared as described (Reidenbach et al., Multimodal small-molecule screening for human prion protein binders, J Biol Chem. 295(39):13516-31 (2020)) was used for a standard curve. Protein knockdown was calculated by dividing the concentration of residual PrP in each treatment brain, by the mean concentration of residual PrP in the saline control brains from the same time point.
RT-qPCR Mouse Prnp RNA was quantified using RT-qPCR. RNA extracts were treated with DNase I (New England BioLabs, M0303S). Library preparation was performed using the RevertAid First Strand Synthesis Kit (Thermo Fisher Scientific, K1691). Taqman qPCR (Thermo Fisher Scientific, 4331182) was performed on cDNA samples using the QuantStudio 7 Flex (Applied Biosystems). AACt values were calculated based on the amplification of Gapdh and normalized to the mean of the no injection controls. Probe and quencher sequences were purchased from Fisher Scientific as premixed Gene Expression Assays (Gapdh control, ID Mm99999915_g1; Prnp target, ID Mm07296968_ml).
Tissue Processing and Sectioning Whole mouse brains harvested from perfused mice were incubated overnight at 4° C. in 4% PFA. Fixed brains were then washed in 1×PBS and dehydrated overnight at 4° C. in 30% sucrose, followed by a second overnight incubation at 4° C. in a 1:1 mixture of 30% sucrose and O.C.T. compound (Tissue-Tek, 4583). Dehydrated brains were placed in cryomolds containing O.C.T. and snap-frozen in liquid nitrogen-chilled isopentane. 10 µm coronal brain sections were cut using a Leica CM3050 S Research Cryostat and placed on SuperFrost Plus slides (VWR, 48311-703). Brains used to extract DNA for Nanopore long-read sequencing were harvested from non-perfused mice and directly embedded in O.C.T. before freezing on dry ice. These were cut into 150 µm sections using a Leica CM3050 S Research Cryostat and stored in tubes at −80° C. before use.
Hybridization Chain Reaction RNA Fluorescence In Situ Hybridization (HCR RNA-FISH)

Coronal brain sections on SuperFros Plus slides were immersed in 4% PFA at 4° C. for 15 minutes and then sequentially immersed in 50% ethanol, 70% ethanol, 100% ethanol, and 1×PBS at room temperature for 5 minutes. A hydrophobic barrier was drawn around the tissue using an ImmEdge™ Hydrophobic Barrier Pen (Vector Laboratories, 101098-065). Third-generation multiplexed HCR RNA-FISH was performed as previously described[97]. Briefly, tissue samples were pre-hybridized in hybridization buffer (Molecular Instruments) at 37° C. for 10 minutes and then incubated in a 37° C. humidified chamber overnight with split-initiator probes hybridizing to the Prnp and Uch11 mRNA transcripts diluted to a concentration of 4 nM in Hybridization Buffer. Split-initiator probes were purchased from Molecular Technologies. The slides were then immersed in 75%, 50%, and 25% probe wash buffer (Molecular Instruments) solutions at 37° C. for 15 minutes, followed by two incubations in 5×SSCT, one for 15 minutes at 37° C. and another for 5 minutes at room temperature. Tissue sections were then equilibrated in amplification buffer (Molecular Instruments) for 30 minutes at room temperature. Separately, metastable fluorescent hairpins conjugated to Alexa Fluor 647 and Alexa Fluor 546 were snap-cooled and diluted to 60 nM in amplification buffer. Samples were incubated in hairpin solution overnight in a dark humidified chamber at room temperature. Excess hairpin amplifiers were removed the next day in 5×SSCT at room temperature before staining with 1 μg/mL DAPI for 10 min, washing again in 5×SSCT, and mounting in VECTASHIELD® PLUS Antifade Mounting Medium (Vector Laboratories, H-1900). Brain sections were imaged as z-stack tile scans on a Zeiss LSM 980 with Airyscan 2 Laser Scanning Confocal with a 20× objective.

Image Analysis

Maximum orthogonal projections and stitching of z-stack tile scales was performed using ZEN Blue software (Zeiss). Cell detection and classification was carried out using QuPath software v0.5.0$^{59}$. Briefly, cells were detected using QuPath's cell detection tool on the DAPI channel (cell expansion=4 μm). QuPath's built-in machine learning classification tool was used to detect neurons (using Uchl1-Alexa Fluor 647 signal) and Prnp+ cells (using Prnp-Alexa Fluor 546 signal). Multiple images were used to train the classifiers. Zoomed-in images of brain regions were median filtered using Fiji software v2.9.0$^{98}$.

Statistical Analyses

All statistical tests performed in this study are indicated in the figure legends.

REFERENCES

1. Nunez et al., *Genome-wide programmable transcriptional memory by CRISPR-based epigenome editing*, Cell 184 (9):2503-19 (2021).
2. Amabile et al., *Inheritable Silencing of Endogenous Genes by Hit-and-Run Targeted Epigenetic Editing*, Cell 167(1):219-32 (2016).
3. Guo et al., Structural insight into autoinhibition and histone H3-induced activation of DNMT3A, Nature 517 (7536):640-44 (2014).
4. Lue et al., *Base editor scanning charts the DNMT3A activity landscape*, Nature Chemical Biology 19(2):176-86 (2022).
5. Jia et al., *Structure of Dnmt3a bound to Dnmt3L suggests a model for de novo DNA methylation*, Nature 449(7159): 248-51 (2007).
6. Koblan et al., *Improving cytidine and adenine base editors by expression optimization and ancestral reconstruction*, Nature Biotechnology 36:9:843-46 (2018).
7. Pabo et al., *Design and selection of novel Cys2His2 zinc finger proteins*, Annual Review of Biochemistry 70:313-40 (2001).
8. Bhakta et al., *The generation of zinc finger proteins by modular assembly*, Methods in Molecular Biology (Clifton, N.J.) 649:3-30 (2010).
9. Paschon et al., *Diversifying the structure of zinc finger nucleases for high-precision genome editing*, Nature Communications 10(1):1-12 (2019).
10. Zeitler et al., *Allele-selective transcriptional repression of mutant HTT for the treatment of Huntington's disease*, Nature Medicine 25(7):1131-42 (2019).
11. Wegmann et al., *Persistent repression of tau in the brain using engineered zinc finger protein transcription factors*, Science Advances 7(12):eabe1611 (2021).
12. Moreno et al., *Long-lasting analgesia via targeted in situ repression of NaV1.7 in mice*, Science Translational Medicine 13(584):eaay9056 (2021).
13. Tanenhaus et al., *Cell-Selective Adeno-Associated Virus-Mediated SCN1A Gene Regulation Therapy Rescues Mortality and Seizure Phenotypes in a Dravet Syndrome Mouse Model and Is Well Tolerated in Nonhuman Primates*, Human Gene Therapy 33(11-12):579-97 (2022).
14. Mlambo et al., *Designer epigenome modifiers enable robust and sustained gene silencing in clinically relevant human cells*, Nucleic Acids Research 46(9): 4456-68 (2018).
15. Challis et al., *Systemic AAV vectors for widespread and targeted gene delivery in rodents*, Nature Protocols 14(2): 379-414 (2019).
16. Prusiner, *Prions*, Proc Natl Acad Sci USA. 95(23): 13363-83. (1998).
17. Simpson et al., *Detecting DNA cytosine methylation using nanopore sequencing*, Nature Methods 14(4):407-10 (2017).
18. Battaglia et al., *Long-range phasing of dynamic, tissue-specific and allele-specific regulatory elements*, Nature Genetics 54(10):1504-13 (2022).
19. Stevens et al., *Design of a Split Intein with Exceptional Protein Splicing Activity*, J Am Chem Soc. 138(7):2162-65 (2016).
20. Levy et al., *Cytosine and adenine base editing of the brain, liver, retina, heart and skeletal muscle of mice via adeno-associated viruses*, Nat Biomed Eng. 4(1):97-110 (2020).
21. Li et al., *Multidimensional control of therapeutic human cell function with synthetic gene circuits*, Science 378 (6625):1227-34 (2022).
22. Vallabh et al., *Towards a treatment for genetic prion disease: trials and biomarkers*, Lancet Neurol. 19(4):361-68. (2020).
23. Maddox et al., *Prion disease incidence in the United States: 2003-2015*, Neurology 94(2): e153-e157 (2020).
24. Büeler et al., *Mice devoid of PrP are resistant to scrapie*, Cell 73(7):1339-47 (1993).
25. Mallucci et al., *Depleting Neuronal PrP in Prion Infection Prevents Disease and Reverses Spongiosis*, Science 302(5646):871-74 (2003).
26. Raymond et al., *Antisense oligonucleotides extend survival of prion-infected mice*, JCI Insight 5(16):e131175 (2019).
27. Büeler et al., *Normal development and behaviour of mice lacking the neuronal cell-surface PrP protein*, Nature 356(6370):577-82 (1992).
28. Benestad et al., *Healthy goats naturally devoid of prion protein*, Vet Res. 43(1):87 (2012).
29. Richt et al., *Production of cattle lacking prion protein*, Nat Biotechnol. 25(1):132-8 (2007).
30. Minikel et al., *Evaluating drug targets through human loss-of-function genetic variation*, Nature 581(7809):459-64 (2020).
31. Minikel et al., *Quantifying prion disease penetrance using large population control cohorts*, Sci Transl Med. 8(322):322ra9 (2016).
32. Küffer et al., *The prion protein is an agonistic ligand of the G protein-coupled receptor Adgrg6*, Nature 536 (7617):464-68 (2016).
33. Skedsmo et al., *Demyelinating polyneuropathy in goats lacking prion protein*, FASEB J. 34(2):2359-75 (2020).
34. Bremer et al., *Axonal prion protein is required for peripheral myelin maintenance*, Nat Neurosci. 13(3): 310-8 (2010).
35. Frost & Diamond, *Prion-like mechanisms in neurodegenerative diseases*, Nat Rev Neurosci. 11(3):155-9 (2010).
36. Saudou & Humbert, *The Biology of Huntingtin*, Neuron 89(5):910-26 (2016).

37. Dantas et al., *Efficacy of anti-amyloid-β monoclonal antibody therapy in early Alzheimer's disease: a systematic review and meta-analysis*, Neurol Sci. (2023).
38. Gilbert et al., *CRISPR-mediated modular RNA-guided regulation of transcription in eukaryotes*, Cell 154(2): 442-51 (2013).
39. Kaluscha et al., *Evidence that direct inhibition of transcription factor binding is the prevailing mode of gene and repeat repression by DNA methylation*, Nat Genet. 54(12):1895-1906 (2022).
40. Charlesworth et al., *Identification of preexisting adaptive immunity to Cas9 proteins in humans*, Nat Med. 25(2): 249-54 (2019).
41. Ren et al. *Immune Responses to Gene Editing by Viral and Non-Viral Delivery Vectors Used in Retinal Gene Therapy*, Pharmaceutics 14(9):1973 (2022).
42. Wagner et al., *High prevalence of Streptococcus pyogenes Cas9-reactive T cells within the adult human population*, Nat Med. 25(2):242-48 (2019).
43. Maeder et al., *Rapid "open-source" engineering of customized zinc-finger nucleases for highly efficient gene modification*, Mol Cell. 31(2):294-301 (2008).
44. Ichikawa et al., *A universal deep-learning model for zinc finger design enables transcription factor reprogramming*, Nat Biotechnol. 41(8):1117-29 (2023).
45. Greenberg et al., *The diverse roles of DNA methylation in mammalian development and disease*, Nat Rev Mol Cell Biol. 20(10):590-607 (2019).
46. Huang et al., *DNA epigenome editing using CRISPR-Cas SunTag-directed DNMT3A*, Genome Biol. 18(1):176 (2017).
47. Van et al., *Nanobody-mediated control of gene expression and epigenetic memory*, Nat Commun. 12(1):537 (2021).
48. Xu et al., *Structure of nucleosome-bound DNA methyltransferases DNMT3A and DNMT3B*, Nature 586(7827): 151-55 (2020).
49. Li et al., *Histone tails regulate DNA methylation by allosterically activating de novo methyltransferase*, Cell Res. 21(8):1172-81 (2011).
50. Zhang et al., *Chromatin methylation activity of Dnmt3a and Dnmt3a/3L is guided by interaction of the ADD domain with the histone H3 tail*, Nucleic Acids Res. 38(13):4246-53 (2010).
51. Veland et al., *DNMT3L facilitates DNA methylation partly by maintaining DNMT3A stability in mouse embryonic stem cells*, Nucleic Acids Res. 47(1):152-67 (2019).
52. Suetake et al., *DNMT3L stimulates the DNA methylation activity of Dnmt3a and Dnmt3b through a direct interaction*, J Biol Chem. 279(26):27816-23 (2004).
53. Chen et al., *Fusion protein linkers: property, design and functionality*, Adv Drug Deliv Rev. 65(10):1357-69 (2013).
54. US20230002459A1: Zinc Finger Protein Transcription Factors for Treatment of Prion Disease.
55. Fang et al., *Chimerization Enables Gene Synthesis and Lentiviral Delivery of Customizable TALE-Based Effectors*, International Journal of Molecular Sciences 21(3): 795 (2020).
56. Choi et al., *Optimization of AAV expression cassettes to improve packaging capacity and transgene expression in neurons*, Mol Brain 7:17 (2014).
57. Ran et al., *In vivo genome editing using Staphylococcus aureus Cas9*, Nature 520(7546):186-91(2015).
58. Chan et al., *Engineered AAVs for efficient noninvasive gene delivery to the central and peripheral nervous systems*, Nat Neurosci. 20(8):1172-79 (2017).
59. Bankhead et al., *QuPath: Open source software for digital pathology image analysis*, Sci Rep. 7(1):16878 (2017).
60. Brandner et al., *Normal host prion protein necessary for scrapie-induced neurotoxicity*, Nature 379(6563):339-43 (1996).
61. Lakkaraju et al., *Glial activation in prion diseases is selectively triggered by neuronal PrPSc*, Brain Pathol. 32(5):e13056 (2022).
62. Ibraheim et al., *Self-inactivating, all-in-one AAV vectors for precision Cas9 genome editing via homology-directed repair in vivo*, Nat Commun. 12(1):6267 (2021).
63. Li et al., *A Self-Deleting AAV-CRISPR System for In Vivo Genome Editing*, Mol Ther Methods Clin Dev. 12:111-22 (2018).
64. Subramanian et al., *RNAi-mediated rheostat for dynamic control of AAV-delivered transgenes*, Nat Commun. 14(1):1970 (2023).
65. Cabrera et al., *The sound of silence: Transgene silencing in mammalian cell engineering*, Cell Syst. 13(12):950-73 (2022).
66. Khalil et al., *A synthetic biology framework for programming eukaryotic transcription functions*, Cell 150 (3):647-58 (2012).
67. Ma et al., *Tuning methylation-dependent silencing dynamics by synthetic modulation of CpG density*, bioRxiv [Preprint]. 2023 Jun. 1:2023.05.30.542205.
68. Wilson & Gilbert, *The Promise and Challenge of In Vivo Delivery for Genome Therapeutics*, ACS Chem Biol. 13(2):376-82 (2018).
69. Leibowitz et al., *Chromothripsis as an on-target consequence of CRISPR-Cas9 genome editing*, Nat Genet. 53(6):895-905 (2021).
70. Grunewald et al., *Transcriptome-wide off-target RNA editing induced by CRISPR-guided DNA base editors*, Nature 569(7756):433-37 (2019).
71. Zuo et al., *Cytosine base editor generates substantial off-target single-nucleotide variants in mouse embryos*, Science 364(6437):289-92 (2019).
72. Jin et al., *Cytosine, but not adenine, base editors induce genome-wide off-target mutations in rice*, Science 364 (6437):292-95 (2019).
73. Yan et al., *Cytosine base editors induce off-target mutations and adverse phenotypic effects in transgenic mice*, Nat Commun. 14(1):1784 (2023).
74. Fiumara et al., *Genotoxic effects of base and prime editing in human hematopoietic stem cells*, Nat Biotechnol. (2023).
75. Hwang et al., *Detailed mechanisms for unintended large DNA deletions with CRISPR, base editors, and prime editors*, BioRxiv, 2024.01.04.574288 (2024)
76. Huang et al., *C-to-G editing generates double-strand breaks causing deletion, transversion and translocation*, Nat Cell Biol. 26(2):294-304 (2024).
77. Kuzmin et al., *The clinical landscape for AAV gene therapies*, Nat Rev Drug Discov. 20(3):173-74 (2021).
78. Santos et al., *A comprehensive map of molecular drug targets*, Nat Rev Drug Discov. 16(1):19-34 (2017).
79. Ling et al., *AAV-based in vivo gene therapy for neurological disorders*, Nat Rev Drug Discov. 22(10):789-806 (2023).

80. Zolotukhin & Vandenberghe, *AAV capsid design: A Goldilocks challenge*, Trends Mol Med. 28(3):183-93 (2022).
81. Huang et al., *An AAV capsid reprogrammed to bind human Transferrin Receptor mediates brain-wide gene delivery*, bioRxiv, 2023.12.20.572615.
82. Hamilton et al., *In vivo human T cell engineering with enveloped delivery vehicles*, Nat Biotechnol. 2024 Jan. 11. doi: 10.1038/s41587-023-02085-z. Epub ahead of print. PMID: 38212493.
83. Khirallah et al., *Clinical progress in genome-editing technology and in vivo delivery techniques*, Trends Genet. 39(3):208-16 (2023).
84. Banskota et al., *Engineered virus-like particles for efficient in vivo delivery of therapeutic proteins*, Cell 185(2):250-65 (2022).
85. Minikel et al., *Prion protein lowering is a disease-modifying therapy across prion disease stages*, strains and endpoints, Nucleic Acids Res. 48(19):10615-31 (2020).
86. Zhang et al., *Deciphering TAL effectors for 5-methylcytosine and 5-hydroxymethylcytosine recognition*, Nature Communications 8(1):1-9 (2017).
87. Miller et al., *Improved specificity of TALE-based genome editing using an expanded RVD repertoire*, Nature Methods 12(5):465-71 (2015).
88. Doench et al., *Optimized sgRNA design to maximize activity and minimize off-target effects of CRISPR-Cas9*, Nature Biotechnology 34(2):184-91 (2015).
89. Altschul et al., *Basic local alignment search tool*, J Mol Biol. 215(3):403-10 (1990).
90. Katoh et al., *MAFFT multiple sequence alignment software version 7: improvements in performance and usability*, Mol Biol Evol. 30(4):772-80 (2013).
91. Nguyen et al., *IQ-TREE: a fast and effective stochastic algorithm for estimating maximum—likelihood phylogenies*, Mol Biol Evol. 32(1):268-74 (2015).
92. Letunic et al., *Interactive Tree Of Life (iTOL) v5: an online tool for phylogenetic tree display and annotation*, Nucleic Acids Res. 49(W1):W293-W296 (2021).
93. Labun et al., *CHOPCHOP v3: expanding the CRISPR web toolbox beyond genome editing*, Nucleic Acids Res. 47(W1):W171-W174 (2019).
94. Liao et al., *featureCounts: an efficient general purpose program for assigning sequence reads to genomic features*, Bioinformatics 30(7):923-30 (2014).
95. Love et al., *Moderated estimation of fold change and dispersion for RNA-seq data with DESeq2*, Genome Biol. 15(12):550 (2014).
96. Kumaki et al., *QUMA: quantification tool for methylation analysis*, Nucleic Acids Res. 36(Web Server issue):W170-5 (2008).
97. Choi et al., *Third-generation in situ hybridization chain reaction: multiplexed, quantitative, sensitive, versatile, robust*, Development 145(12):dev165753 (2018).
98. Schindelin et al., *Fiji: an open-source platform for biological-image analysis*, Nat Methods. 9(7):676-82 (2012).

The teachings of all patents, published applications and references cited herein are incorporated by reference in their entirety.

While example embodiments have been particularly shown and described, it will be understood by those skilled in the art that various changes in form and details may be made therein without departing from the scope of the embodiments encompassed by the appended claims.

---

SEQUENCE LISTING (510 sequences)

SEQ ID NO: 1 - protein, 1367 aa, synthetic construct
  REGION 1..1367: note = synthetic sequence for use in compositions and/or methods
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 2 - DNA, 4101 bp, synthetic construct
  misc_feature 1..4101: note = synthetic sequence for use in compositions and/or methods
  source 1..4101: mol_type = other DNA
gacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgac

SEQ ID NO: 3 - protein, 185 aa, Homo sapiens
GVPAAMAERPFQCRICMRNFSRSDHLSEHIRTHTGEKPFACDICGRKFAARSTRTNHTKIHTGSQKPFQCRICMRNFSRSDDLTRHIRTHTGEKPFACDICGRKFAQSSDLRRHTKIHTGSQKPFQCRICMRNFSQSGSLTRHIRTHTGEKPFACDICGRKFADRSHLARHTKIHLRQKDAARGS

SEQ ID NO: 4 - protein, 197 aa, Homo sapiens
GVPAAMAERPFQCRICMNFSYKCCLSDHIRTHTGEKPFACDICGRKFARSANLTRHTKIHTGSQKPFQCRICMNFSRSDHLSAHIRTHTGEKPFACDICGRKFADRSALARHTKIHTHPRAPIPKPFQCRICMNFSIKHDLHRHIRTHTGEKPFACDICGRKFARSANLTRHTKIHLRQKDAARGSGGDAKSLTAWS

SEQ ID NO: 5 - protein, 195 aa, Homo sapiens
GVPAAMAERPFQCRICMQNFSYPKDLARHIRTHTGEKPFACDICGRKFATSGNLTRHTKIHTGSQKPFQCRICMQNFSTSGSLSRHIRTHTGEKPFACDICGRKFAQSADRTKHTKIHTGSQKPFQCRICMNFSQSGDLTRHIRTHTGEKPFACDICGRKFAYRWLRNNHTKIHLRQKDAARGSGGDAKSLTAWS

SEQ ID NO: 6 - protein, 197 aa, Homo sapiens
GVPAAMAERPFQCRICMNFSRSADLTRHIRTHTGEKPFACDICGRKFAQSGDLTRHTKIHTHPRAPIPKPFQCRICMNFSRSDHLSRHIRTHTGEKPFACDICGRKFADRSNRKTHTKIHTGSQKPFQCRICMNFSTSGSLSRHIRTHTGEKPFACDICGRKFAQNANLMKHTKIHLRQKDAARGSGGDAKSLTAWS

SEQ ID NO: 7 - protein, 196 aa, Homo sapiens
GVPAAMAERPFQCRICMRNFSTSGHLSRHIRTHTGEKPFACDICGRKFAQSGHLSRHTKIHTGSQKPFQCRICMRNFSDRSHLTRHIRTHTGEKPFACDICGRKFAQSSDLRRHTKIHTGSQKPFQCRICMRNFSDRSYRNTHIRTHTGEKPFACDICGRKFARRSDLKRHTKIHLRQKDAARGSGGDAKSLTAWS

SEQ ID NO: 8 - protein, 195 aa, Homo sapiens
GVPAAMAERPFQCRICMQNFSDRSNLSRHIRTHTGEKPFACDICGRKFALRQDLKRHTKIHTGSQKPFQCRICMQNFSDRSALSRHIRTHTGEKPFACDICGRKFAQSGDLTRHTKIHTGSQKPFQCRICMNFSRSANLARHIRTHTGEKPFACDICGRKFADSSDRKKHTKIHLRQKDAARGSGGDAKSLTAWS

SEQ ID NO: 9 - protein, 197 aa, Homo sapiens
GVPAAMAERPFQCRICMNFSQSGHLARHIRTHTGEKPFACDICGRKFAQLTHLNSHTKIHTHPRAPIPKPFQCRICMNFSRSDNLARHIRTHTGEKPFACDICGRKFAMRHHLDDHTKIHTGSQKPFQCRICMNFSLRHHLTRHIRTHTGEKPFACDICGRKFADRSYRNTHTKIHLRQKDAARGSGGDAKSLTAWS

SEQ ID NO: 10 - protein, 200 aa, Mus musculus
GVPAAMAERPFQCRICMRNFSRSDDLTRHIRTHTGEKPFACDICGRKFAQSSDLRRHTKIHTGSQKPFQCRICMRNFSDRSHLTRHIRTHTGEKPFACDICGRKFARLDWLPMHTKIHTHPRAPIPKPFQCRICMRNFSTSGNLTRHIRTHTGEKPFACDICGRKFADLTTLRKHTKIHLRQKDAARGSGGDAKSLTAWS

SEQ ID NO: 11 - protein, 200 aa, Mus musculus
GVPAAMAERPFQCRICMRNFSTSGNLTRHIRTHTGEKPFACDICGRKFALSQDLNRHTKIHTHPRAPIPKPFQCRICMRNFSDRSALSRHIRTHTGEKPFACDICGRKFARNDDRKKHTKIHTGSQKPFQCRICMRNFSQSGNLARHIRTHTGEKPFACDICGRKFAQRIDLTRHTKIHLRQKDAARGSGGDAKSLTAWS

SEQ ID NO: 12 - protein, 196 aa, Mus musculus
GVPAAMAERPFQCRICMRNFSDRSALARHIRTHTGEKPFACDICGRKFAMACCRYAHTKIHTGSQKPFQCRICMRNFSDRSDLSRHIRTHTGEKPFACDICGRKFARRTDLRRHTKIHTGSQKPFQCRICMRNFSSEADRSRHIRTHTGEKPFACDICGRKFADRSNLTRHTKIHLRQKDAARGSGGDAKSLTAWS

SEQ ID NO: 13 - protein, 196 aa, Mus musculus
GVPAAMAERPFQCRICMRNFSRSDHLSEHIRTHTGEKPFACDICGRKFAYSWRLSQHTKIHTGSQKPFQCRICMRNFSLRHHLTRHIRTHTGEKPFACDICGRKFAQSGTRKTHTKIHTGSQKPFQCRICMRNFSRSDVLSKHIRTHTGEKPFACDICGRKFARSDDRIKHTKIHLRQKDAARGSGGDAKSLTAWS

SEQ ID NO: 14 - protein, 200 aa, Mus musculus
GVPAAMAERPFQCRICMQNFSWNSDLRKHIRTHTGEKPFACDICGRKFAQSGNLARHTKIHTGSQKPFQCRICMQNFSQSSDLSRHIRTHTGEKPFACDICGRKFAHRSTRNRHTKIHTHPRAPIPKPFQCRICMQNFSRSDDLSRHIRTHTGEKPFACDICGRKFAQSANRTKHTKIHLRQKDAARGSGGDAKSLTAWS

SEQ ID NO: 15 - protein, 196 aa, Mus musculus
GVPAAMAERPFQCRICMRNFSRSADLTRHIRTHTGEKPFACDICGRKFADRSALARHTKIHTGSQKPFQCRICMRNFSQSGHLARHIRTHTGEKPFACDICGRKFAQKGTLGEHTKIHTGSQKPFQCRICMRNFSIRSTLRDHIRTHTGEKPFACDICGRKFAHRSSLRRHTKIHLRQKDAARGSGGDAKSLTAWS

SEQ ID NO: 16 - DNA, 555 bp, Homo sapiens
  source 1..555: mol_type = genomic DNA
ggggtacccgccgctatggctgagaggcccttccagtgtcgaatctgcatgcgtaacttcagtcgctccgaccacctgtccgagcacatccgcacccacaccggcgagaagccttttgcctgtgacatttgtgggaggaaatttgccgcccgctccacccgcaccaaccataccaagatacacacgggcagccaaaagcccttccagtgtcgaatctgcatgcgtaacttcagtcgctccgacgacctgacccgccacatccgcacccacaccggcgagaagccttttgcctgtgacatttgtgggaggaaatttgcccagtcctccgacctgcgccgccataccaagatacacacgggatctcagaagcccttccagtgtcgaatctgcatgcgtaacttcagtcagtccggctccctgacccgccacatccgcacccacaccggcgagaagccttttgcctgtgacatttgtgggaggaaatttgccgaccgctcccacctggcccgccataccaagatacacctgcgccaaaaagatgcggcccggggatcc

SEQ ID NO: 17 - DNA, 591 bp, Homo sapiens
  source 1..591: mol_type = genomic DNA
ggagtgcccgccgccatggccgaacggcctttccagtgcagaatctgcatgaacttcagctacaagtgctgcctgtctgatcacatccggacccacaccggcgagaaaccttttgcctgtgacatctgcggaagaaagttcgcccggagcgctaatctgaccagacataccaagatccacacaggcagccagaaacctttccagtgccggatctgtatgaacttctctagaagcgaccacctgagcgcccacatcagaacacatacaggcgagaagccattcgcttgcgacatctgcggcagaaagtttgctgatagatctgccctggcccggcacaccaagatccacacccaccccagagcccctatccccaagcctttccaatgtcggatctgcatgaacttcagcatcaagcacgacctgcacagacacattcgcacccacaccggcgaaaaaccttttgcctgcgacatctgtggcagaaagttcgccaggtccgccaacctgacaagacacacaaagatccacctgagacagaaggacgccgctagaggcagcggcggagatgccaagagcctgaccgcctggtcc

SEQ ID NO: 18 - DNA, 585 bp, Homo sapiens
  source 1..585: mol_type = genomic DNA
ggagtgcctgctgctatggccgagcggcctttccagtgtcggatctgtatgcaaaatttcagctaccccaaggacctggccagacacatccggacacacaccggcgaaaagccttttgcctgcgacatctgcggccgcaaattcgctacaagcggcaacctgacaagacatacaaaaatccacaccggctctcaaaagcctttccagtgcaggatctgcatgcagaacttctccaccagcggatctctgagcagacacattagaacccataccggcgagaagccattcgcctgtgacatctgcggcagaaagttcgcccagagcgccgatagaacaaagcacacaaagatccacaccggcagccagaaaccttttcagtgcagaatctgcatgaacttcagccagagcggcgatctgaccagacacatcagaacccacaccggagaaaagccctttgcctgcgatatctgtggccggaagttcgcctaccggtggctgcggaacaaccacaccaagatccacctgagacagaaggacgccgccagaggctctggcggcgacgccaagagcctgaccgcctggtcc

SEQ ID NO: 19 - DNA, 591 bp, Homo sapiens
  source 1..591: mol_type = genomic DNA
ggcgttccagcagctatggcagaaagaccgtttcagtgccgcatttgcatgaacttttctcgctccgctgatcttacacgacatatccgtacgcataccggcgagaaaccctttgcttgtgatatttgtgggcgaaaatttgctcaaagcggtgatttaactaggcatacgaagatacatacccacccgcgggctcccataccaaaacctttccaatgccgcatttgtatgaattttagcagatcagatcatctctcccgacacattaggacgcatactggggagaaaccctttgcctgtgatatttgtggtaggaaatttgcagaccggagcaaccggaagacccacaccaagatccacaccggatctcagaaaccttttcagtgccggatctgcatgaacttcagcaccagcggcagcctgagccgccacatcagaacacacaccggcgagaagccctttgcttgtgatatctgcggaagaaaattcgctcagaacgccaacctgatgaagcacacaaagatccacctgagacagaaggacgccgctagaggctctggcggcgatgccaagagcctgaccgcctggtcc

SEQ ID NO: 20 - DNA, 588 bp, Homo sapiens
  source 1..588: mol_type = genomic DNA
ggcgtgcccgccgccatggccgagagacctttccagtgcagaatctgcatgcgcaacttcagcaccagcggccacctgtctagacacatcagaacccacaccggcgaaaagcctttcgcctgtgatatctgcggcagaaagttcgctcaaagcggccacctgagcagacatacaaagatccacaccggaagccagaaaccatttcagtgtagaatctgcatgagaaacttctccgacagaagccacctgacaagacacattcggacccacacaggcgagaaacctttcgcctgcgacatctgcggccggaaattcgcccagagcagcgatctgcggagacacaccaagatccacacaggatctcagaagccctttcagtgccggatctgcatgcggaatttcagcgaccggagctacagaaacacccacatccggacacataccggcgaaaagccttttgcttgtgacatctgtggcagaaagttcgccagaaggtccgacctgaagcggcacaccaagatccacctgagacagaaggacgccgctagaggctctggcggagatgccaagagcctgaccgcctggtcc

SEQ ID NO: 21 - DNA, 585 bp, Homo sapiens
  source 1..585: mol_type = genomic DNA
ggcgtgcccgccgccatggccgagagacctttccagtgccggatctgcatgcagaacttctccgatagaagcaacctgagccggcacatcagaacacacaccggcgagaagcctttcgcctgcgacatctgtggaaggaagttcgccctgcggcaggacctgaagcggcataccaagatccacacaggctctcagaagccatttcagtgcagaatctgcatgcaaaacttcagcgaccgctccgccctgtctagacacattcggacccacaccggagaaaagccctttgcctgtgatatctgtggcagaaagttcgcccagagcggagatctgaccagacatacaaagatccacacaggcagccagaaacctttccaatgtagaatctgcatgaacttcagcagatctgctaatctcgccagacacatccggacccacaccggcgaaaaaccttttgcctgcgacatctgcggcagaaaattcgctgatagcagcgaccggaaaaagcacacaaagatccacctgagacagaaggacgccgctagaggcagcggcggcgacgcaaagagcctgaccgcctggtcc

SEQ ID NO: 22 - DNA, 591 bp, Homo sapiens
  source 1..591: mol_type = genomic DNA
ggtgttcccgcagctatggcagaaagaccctttcagtgcaggatttgtatgaacttttctcaatctgggcatttggcccgccatatacgcacacatactggggaaaagcccttcgcttgtgatatttgtggacggaagtttgcacaacttacgcatctcaattcccatactaagattcatacgcacccccgcgcaccaattccgaaaccattccaatgtcgtatatgtatgaacttttcacgctcagataatttggctaggcatattagaacgcataccggtgagaaaccgtttgcgtgcgatatttgcggccgaaaatttgctatgcgtcatcatttggacgatcatactaaaattcatactgggagccaaaagcccttccaatgtcgcatatgtatgaatttcagcctgcggcatcacctgaccagacacatcagaacacatacaggcgaaaagccattcgcctgcgacatctgtggcagaaagttcgcagatagatcctaccgcaacacccacaccaagatccacctgagacagaaggacgctgccaggggcagcggaggagatgccaagagcctgaccgcctggtcc

SEQ ID NO: 23 - DNA, 600 bp, Mus musculus
  source 1..600: mol_type = genomic DNA
ggagttcccgcagcaatggcagaaaggcctttccaatgtcgcatttgtatgcgaaattttagccggagcgatgatttgacccgccatatacgaactcatactggagagaaaccttttgcatgcgacatctgcgggcggaaatttgctcaatcatcagatcttcgacgtcataccaaaattcatacaggcagtcaaaagccttttcaatgtaggatttgtatgcgcaactttagtgaccgcagtcatttaacacgccacattcgcactcacaccggcgagaagccatttgcatgtgacatttgtgggcgtaaatttgccaggttggattggcttccaatgcatactaaaatacatactcatccacgagctccgataccaaaaccatttcagtgccgaatttgtatgcgcaattttagcaccagcggcaacctgaccagacacatcagaacccacaccggagagaaaccttttgcctgtgacatctgcggccggaagtttgccgacctgacaacactgagaaagcacaccaagatccacctcagacagaaagacgccgccagaggcagcggcggcgatgccaagagcctgaccgcctggtcc

SEQ ID NO: 24 - DNA, 600 bp, Mus musculus
  source 1..600: mol_type = genomic DNA
ggagtgcctgctgctatggccgagagaccatttcagtgcagaatctgcatgcgcaatttcagcaccagcggaaatctcacaagacacatccggacccataccggcgagaagccctttgcctgcgatatctgcggcagaaagttcgctctgtctcaggacctgaaccggcacaccaagatccacacacaccccagagcccctatccccaagcctttccagtgccggatttgcatgcggaacttcagcgacaggtccgccctgagcagacatatcagaacacacaccggcgaaaagccttttgcttgtgatatctgtggcagaaagttcgcccggaacgacgacagaaaaaagcacacaaagatccacaccggatctcagaaacctttccaatgtagaatctgcatgagaaacttcagccagagcggcaacctggccagacacatccggacccacacaggcgaaaagcctttcgcctgtgatatctgcggccggaaattcgcccagagaatcgacctgacccggcacaccaagatccacctgagacagaaggacgccgccagaggcagcggcggcgacgccaagagcctgaccgcctggtcc

SEQ ID NO: 25 - DNA, 588 bp, Mus musculus
  source 1..588: mol_type = genomic DNA
ggcgtgcccgccgccatggctgaaagaccttttcagtgcagaatctgtatgaggaacttcagcgaccggtccgccctggccagacacatccgcacccacaccggcgagaagcctttcgcctgcgacatctgcggccggaagttcgccatggcctgctgcagatacgcccacaccaagatccacacaggatctcagaaacctttccagtgccggatctgcatgcggaacttcagcgaccggtctgatctgagcagacatattcggacccataccggcgaaaaaccttttgcctgtgatatctgtggcagaaagttcgctagacggacagatctgcggagacacaccaagatccacaccggaagccagaagccattccaatgtagaatctgcatgagaaatttcagcagcgaggccgacaggtctagacacatcagaacacacaccggcgagaagccctttgcttgcgacatctgcggcagaaaattcgccgatagaagcaacctgacaagacacacaaagatccacctgagacagaaggacgccgctagaggaagcggcggcgacgccaagagcctgaccgcctggtcc

SEQ ID NO: 26 - DNA, 588 bp, Mus musculus
  source 1..588: mol_type = genomic DNA
ggcgtgcccgctgctatggccgagcggcctttccagtgtagaatctgcatgcgcaatttcagcagatctgaccacctgagcgagcacattcggacacacaccggagagaagccttttgcctgcgatatctgtggaagaaagttcgcctacagctggcggctgtcccagcacaccaagatccacaccggctctcaaaaaccctttcagtgcaggatctgtatgcggaacttcagcctgcggcaccacctgaccagacacatccggacccacactggggagaaaccctttgcttgcgacatttgtggacgtaaatttgcccaaagtgggacccgcaaaacgcataccaagattcatacaggaagccaaaagccattccaatgtcggatatgtatgaggaattttagcagatcagacgtcttgtccaaacatattcgcactcacaccggggagaaaccttttgcgtgtgatatttgtggtaggaaatttgcgagaagcgacgacagaatcaagcacaccaagatccatctgagacagaaagacgccgccagaggcagcggcggcgacgccaagagcctgacagcctggtcc

SEQ ID NO: 27 - DNA, 600 bp, Mus musculus
  source 1..600: mol_type = genomic DNA
ggagtgcccgccgctatggccgagcggccttttcagtgcagaatctgcatgcagaatttctcttggaacagcgatctgagaaagcatattaggacgcatacaggggagaaaccattcgcgtgcgacatctgcggcagaaagttcgcccagagcggcaacctggccagacacaccaagatccacacaggctctcagaaacctttccaatgtagaatctgcatgcagaacttcagccagagcagcgacctgtcacggcatattaggacccatacaggtgagaaacccttcgcatgtgacatctgtggaagaaagttcgcccacagaagcacaagaaaccggcacaccaaaatccacacacatcctagagcccctatccccaagcctttccagtgccggatctgcatgcaaaatttcagccggtctgacgacctgtccagacatattcggacccacaccggcgagaagccattcgcctgtgatatctgcggcagaaaattcgctcagtccgccaaccgcaccaagcacaccaagatccacctgcggcagaaggacgccgccaggggcagcggcggagatgccaagagcctgaccgcctggtcc

SEQ ID NO: 28 - DNA, 588 bp, Mus musculus
  source 1..588: mol_type = genomic DNA
ggcgtgcctgccgccatggccgagcggcctttccagtgcagaatctgtatgcggaacttctctagaagcgccgacctgaccagacacatcagaacacacacaggagaaaagccatttgcctgcgacatctgcggcagaaagttcgctgatagatctgccctggctcggcatactaaaattcatacgggatctcagaagccttttcagtgtagaatctgcatgcggaacttcagccagagcggccacctggccaggcatattcggacacacaccggcgaaaagcccttcgcctgtgacatctgcggaagaaagttcgcccagaagggcaccctgggtgaacatacaaagattcatacggggagtcaaaagcctttccagtgccggatctgcatgagaaatttcagcatccgctccaccctgagagatcacatccggacccacaccggagagaagccttttgcttgtgatatctgcggcagaaaattcgcccacagaagcagcctgcggagacataccaagatccacctgagacagaaggacgccgctagaggctctggcggcgacgccaagagcctcacagcctggtcc

SEQ ID NO: 29 - protein, 301 aa, synthetic construct
  REGION 1..301: note = synthetic sequence for use in compositions and/or methods
NHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACV

SEQ ID NO: 30 - DNA, 903 bp, synthetic construct
  misc_feature 1..903: note = synthetic sequence for use in compositions and/or methods
  source 1..903: mol_type = other DNA
aaccacgaccaggagtttgatcctcctaaggtgtatcctcctgtgcccgcagaaaagcgaaaacctatcagagtgctgtcactgttcgacggcatcgccaccggcctgctggtgctgaaggacctcggcatccaggtggaccggtacatcgctagcgaggtgtgcgaggacagcatcaccgtgggcatggtgaggcaccagggcaagatcatgtacgtgggagatgtgagaagcgtgacccagaaacacatccaggagtggggccccttcgacctggtgatcggcggcagcccctgcaacgacctgagcatcgtgaatccagccagaaagggcctgtacgagggcactggcagactgtttttcgagttctacagactgctgcacgatgccagacctaaagagggagatgacaggcctttcttctggctgttcgagaacgtggtggccatgggcgtgagtgataagagagatatcagcagattcctggaatctaaccccgtcatgatcgacgccaaggaggtgtccgccgcccaccgggccagatacttctggggaaatctgcctggcatgaacagacctcttgcttctaccgtgaacgacaagctggaactgcaggagtgcctggaacacggccggatcgccaaattctccaaggtgagaacaatcaccacaagaagcaacagcattaagcagggaaaggaccaacatttccccgttttcatgaacgagaaggaggatatcctgtggtgcaccgagatggaaagagtgtttggctttccagtgcactacaccgacgtttctaatatgagcagactggccagacaaagactgctgggcagaagctggagcgtgcctgtgatccggcacctgtttgcccctctgaaggaatatttcgcctgtgtg

SEQ ID NO: 31 - protein, 214 aa, Mus musculus
GPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPL

SEQ ID NO: 32 - protein, 213 aa, Apodemus sylvaticus
SPVEIYKTVSAWKRQPIRVLSLFGNIDKELKSLGFLESGSHSEGGTLKYVEDVTNVVRRDVEKWGPFDLLYGSTQPLGGSCDRCPGWYMFQFHRILQYARPRQESQPFFWIFMDNLLLTEDDQMTTVRFLQTEAVTLRDVRSRVLQNAVRVWSNIPGLKSKHEALSPKEEESLQGHVRTRSKLAAPKVDPLVKNCLLPLREYFKYFSQSSLPL

SEQ ID NO: 33 - protein, 213 aa, Camelus bactrianus
SPLEMYKTVPVWKREPVRVLSLFGDIKKELTSLGFLESGSGPGRLRHLDDVTDVVRRDVEEWGPFDLTYGSTPPLGHTCDHPPGWYLFQFHRVLQYARPRRGSQQPFFWMFVDNLVLTEEDRAVATRFLEMDPVTIQHVRGRTTQNAVHVWSNIPAVRSRHSALVSQEELALLAQDRQRAKPPAQEPAALVKNCFLPLREYFKYFSTELTSSL

SEQ ID NO: 34 - protein, 214 aa, Chinchilla lanigera
SPEQMYKTVPVWKRQPVRVLSLFGNIKQELTSLGFLETGSQAGRLRHLKDVTDVVRRDVEEWGPFDLVYGSTPARGHTCDRSPGWFLFHFHRLLQYARPPPSSPQPFFWMFVDNLLLTSEDQATATRFLETEPTTLQDIRGQVLHGAVRVWSNIPAVRSRHSALAPEEEASLLAHVTRGTELSARGPASLVKNCFLPLREYFSYFSQNSLPLYK

SEQ ID NO: 35 - protein, 213 aa, Choloepus didactylus
SPLEMYKTVPAWKREPVRVLSLFGDIKKELLSLGFLESGSGQERLRHLEDVTDVVRRDVEEWGPFDLLYGATPPLGHPCEHPPGWYVFQFHRLLQYARPRPGSGQPFFWMFVDNLVLTAEDRAVASRFLETDPVTIQDARGRAVQDAVRVWSNLPAVKSRDSALAPEDELSLRAWDRQRAKLPAQGPAALVKNCFLPLREYFKYFSMELTSSL

SEQ ID NO: 36 - protein, 216 aa, Cricetulus griseus
SPLEMYKTVSAWKRQPMRVLSLFGNIDKELKSLGFLESGSRTEEGRLKYLDDVTNVVRRDVERWGPFDLVYGSTQPLGYSCDHCPGWYMFQFHRILQYARPHPGSQQPFFWIFVDNLLLSEDDQVTAARFFQTEAVTLQDVRGRVLQNAVRVWSNIPGLKSKHSALTPKEEQSLEGHVRTRAKVAAQKTDALVKNCLLPLREYFKYFSQNPLPLYK

SEQ ID NO: 37 - protein, 213 aa, Equus asinus
SPLEMYKTVPVWKREPVRVLSLFGDIKKELTSLGFLENGSDPGRLKHLDDVTNTVRRDVEEWGPFDLVYGSTPPLGHACDHPPGWYLFQFHRVLQYARPRPGSPQAFFWMFVDNLVLTEDDRAVATRFLETDPVTIQDVCGRAVRNAVHVWSNIPAVKSRHSALFSQEESFLRAQDRQRAKPPARGPAKLVKNCFLPLREYFKYFSTEFTSSL

SEQ ID NO: 38 - protein, 213 aa, Homo sapiens
NPLEMFETVPVWRRQPVRVLSLFEDIKKELTSLGFLESGSDPGQLKHVVDVTDTVRKDVEEWGPFDLVYGATPPLGHTCDRPPSWYLFQFHRLLQYARPKPGSPRPFFWMFVDNLVLNKEDLDVASRFLEMEPVTIPDVHGGSLQNAVRVWSNIPAIRSRHWALVSEEELSLLAQNKQSSKLAAKWPTKLVKNCFLPLREYFKYFSTELTSSL

SEQ ID NO: 39 - protein, 216 aa, Jaculus jaculus
GSLEVFKTVPAWKREPIRVLSLFGDIRKELTSLGFLESGSGSEEGKLKYLDDVTDVVRRDVGKWGPFDLMYGSTQPRSHSCHNCPAWYMYQFHRILQYAQPNSKSQQPFFWMFADNLLLSDEDVRTANRFFEMQFVILQDVCDRVPQNAVRVWSNIPALRSRHMALTPEEEESLKAQVKAKAKLAVQGPPSLVKNCFLPLREYFKYFSENSLPPYP

SEQ ID NO: 40 - protein, 213 aa, Lemur catta
SPLEMYQTVPVWKREPVRVLSLFGDIKRELTSLGFLEDGAGPGGLKYLDDVTDVVRRDVEEWGPFDLLYGATPPLGHTCYHPPGWYLFQFCRLRQYARPPPGSPRPFFWMFVDNLVLTQEDVAAATRFLEMEPVTIQDVCGRALQDATRVWSNIPAVRSKHSGPISEEELSLLAQDRQRARLPPRTPAQLVKNCFLPLREYFKYFSAELTSSL

SEQ ID NO: 41 - protein, 212 aa, Manis javanica
SPLEMYKTVPVWKREPVRVLSLFGDIKKELTSLGFLETGSDPGRLKHLDDVTDVVRRDVREWGPFDLVYGSTPPLGHACDHPPGWYLFQFHRILQYSRPRLASQQPFFWMFVDNLVLREDDRTTATRFLETDPVTIPDACGRAIHNAVHVWSNIPAVKSRHSALVSEEELSLLAQDKQRAKAPTQRPANLVKNCFLPLREYFKYFTELTSSL

SEQ ID NO: 42 - protein, 212 aa, Marmota monax
SPQEIYKTVPAWKREPVRVLSLFGDIRKELTSLGFLEPGSEAGRLRHLEDVTDIVRRDVEEWGPFDLVYGSTPALGHACDHSPGWYLFQFHRLLQYARPRAGSPQAFFWMFVDNLLLTGDEQAIAARFLETEPVILQDVRGSALQNAVRVWTNIPAVKSRHSASEEELLLLAQDGQRGTLPAQGPSALVKNCFLPLREYFKYFSQNALPLYK

SEQ ID NO: 43 - protein, 216 aa, Microtus ochrogaster
NPVKMYKIVSAWKRQPVRVLNLFGKIDKELESLGFLESGSGSEEGRLKYLEDVTNVVRRDVERWGPFDLVYGSTQPLGYSCNRCPGWYMFQFHRILQYAQPPSGSQQPFFWLFMDNLLLTEDDQATATRFFQVEAVTLQDVRSRVLQNAVRVWSNIPGLKSKHSALTPKELQSLETQTRTRGKMAAQKVDLLVKTCLLPLREYFKYFSQNPLPLYK

SEQ ID NO: 44 - protein, 214 aa, Ochotona princeps
QPLEIYETVPACRRKPLRVLSLFEHIEKELASLGFLETGSSPGRIRHLDDVTDVVRRDVEQWGPFDLVYGSTPPLGHASPRSPGWYLFQFHRMLQYTQPTASTQRPFFWMFVDNLLLTRDDLVTATRFLEVEPATLQDVRGRVLQGAMRVWSNIPAVNSRHTELAPEAETALLAQSCRRAKASGEGLARLLKSCFLPLREYFKYFPQSPLPLRK

SEQ ID NO: 45 - protein, 211 aa, Pteropus giganteus
SPLEMYKTVPVWKREPVRVLSLFGDIKAELASLGFLESGSGPGRLKHLDDVTNTVRKDVEQWGPFDLVYGATPPFGQACDRPPGWYLFQFHRVLQYARPGGPRPFFWMFVDNLVLTEDDRAVASRFLEADPVTIRDACGRALQDAVHVWSNIPAVRSRHSALLPHEELSLLARDRQRARHPTPGPARLVKNCFLPLREYFKYFSTELTSSV

SEQ ID NO: 46 - protein, 214 aa, Rattus rattus
SPVEIYKTVSAWKRQPVRVLSLFGNIDKELKSLGFLESGSGSEGGTLKYVEDVTNVVRREVEKWGPFDLVYGSTQPLGYSCDRCPGWYMFQFHRILQYARPRQDSQQPFFWIFVDNLLLTEDDQETTVRFLQTEAVTLQDVRGRVLQNAVRVWSNIPGLKSKHADLTPKEEQSLRTQVRTRSKLAAQKVDSLVKYCLLPLREYFKYFSQNSLPL

SEQ ID NO: 47 - protein, 212 aa, Saimiri boliviensis
SPLEMFETLPVWRRQPVRVLALFGDIKKELTSLGFLGSGSDQGRLKHLDDVTDVVRKDVEEWGPFDLLYGATPAPGHACDHPPAWYLFQFHRLLQYARPSGSPRPFFWMFVDHLMLNKEDQDLVCRFLEMEQATIPDVRGGVLQSAVRVWSNIPAIRSRHWALPSEEELSVLTQNRQSSKLPAQRPTKLLKNCFLPLREYFKYFSTELTSST

SEQ ID NO: 48 - protein, 210 aa, Sus scrofa
SPLEMYKTVPVWKREPVRVLSLFGDIKKELMSLGFLENGSEAGTRRHLDDVTNVVRREVEDWGPFDLVYGSTPPLGRAFDRPPGWYLFQFHRILQYARPRPGSQQPFFWMFVDNLVLSEDDRAVATRFLETDPVTVQDAHGRTVRNAVHVWSNIPAVRSRHSAVVSQEELSLLAQDRQPPAQSPAALVKNCFLPLREYFKYFSAELTSCL

SEQ ID NO: 49 - protein, 213 aa, Ursus arctos
NPLETYKTVPVWKREPVRVLSLFGDIRRELVSLGFLENGSAPGRLKHLDDVTDVVRRDVEGWGPFDLVYGSTPPIGHACDHPPVWYLFQFHRILQYARPRPGSRQPFFWMFVDNLLLSQDDQTAATRFLEADPVTIQDVCGRAVRNAVHVWSNIPAVRSRHAALASCEELSLLAQDRQRTKPPAQGPAQLVKNCFLPLREYFKYFSTELTSSL

SEQ ID NO: 50 - protein, 211 aa, Vombatus ursinus
RPLEMYKTMPEWKRKPIQVLSLFGDIEEELVKFGFLENSSGNGNLKHLDDVTDVLRKDVEEWGPFDLIYGSTPPIGQISEHPPVWYFLQYYRVLQYGKPKMDSEKPFFWMFVDSLVLTKDDREIASRFLETDPVTIYEVCDEMIKNAVLVWSNIPSMKSNNSALTSDWDLPLVAQDIQSLNDFSLWPASLVNKCFNPLKEYFKCFSKDHTS

SEQ ID NO: 51 - DNA, 642 bp, Mus musculus
  source 1..642: mol_type = genomic DNA
ggacctatggaaatctacaagaccgtgtccgcttggaagcgccagcccgtgcgggtgctcagcctgtttagaaacatcgacaaggtgctgaaaagcctgggattcctggaatccggatctggcagcggcggcggcaccctgaagtacgtggaagatgtgacaaacgtggttaggcgggacgtcgagaagtggggcccttttgacctggtgtacggctccacccagcccctgggctccagctgtgaccggtgccccggctggtacatgttccagttccacagaatactgcagtacgccctgcctagacaggagagccagcggcctttcttctggatcttcatggacaacctgcttctgaccgaagatgatcaggagacaacaaccagattcctgcagaccgaagccgtgaccctgcaagacgtgcggggccgggactaccagaacgctatgagagtgtggtccaacatccccggcctgaagagcaagcacgcccccctgacccctaaagaagaagagtacctgcaggcccaagtgcggagcagaagcaagctggacgcccctaaggtggatctgctggtgaagaactgtctgctgcctctcagagagtactttaaatacttcagccagaacagcctccctctg

SEQ ID NO: 52 - DNA, 639 bp, Apodemus sylvaticus
  source 1..639: mol_type = genomic DNA
tcccctgttgagatctacaagaccgtgtccgcctggaagcggcagccaatcagagtgctgagcctgttcggcaatattgacaaggaactgaagtctctgggcttcctggaaagcggcagccacagcgagggcggcacactgaagtacgtggaagatgtgaccaacgtggtgcggagagatgtggaaaagtggggacctttcgacctgctgtacggcagcacccagcctctgggcggaagctgcgacaggtgtcctggctggtacatgttccaatttcatagaatcctgcagtacgccagacctagacaggagtctcagcccttcttctggatcttcatggataacctgctgctcacagaggacgaccagatgaccaccgtgcggttcctgcaaacagaggccgtcaccctgcgcgacgtgagatctagagtgctgcagaacgccgtccgggtgtggagcaacatccccggtcttaaaagcaagcacgaggctctgtccccaaaagaggaagagagcctgcagggccacgtgcggaccagatctaagctggccgctcctaaagtggaccccctggtgaagaactgcctgctgcctctgagagagtactttaagtatttcagccagagcagcctgcccctg

SEQ ID NO: 53 - DNA, 639 bp, Camelus bactrianus
  source 1..639: mol_type = genomic DNA
agccctctggagatgtataagaccgtgcctgtgtggaaaagagagcctgtgcgggtgctgagcctgtttggcgacatcaagaaagagctgacaagcctgggcttcctggaatctggatctggccctggcagactgagacacctggacgatgtgacagatgtcgtgcggcgggacgtcgaggaatggggccccttcgatctgacctacggctctacacctcctctgggccacacatgtgaccaccctccaggctggtacctgttccagttccacagagtgctgcagtacgcccgccccagaagaggcagccagcaacctttcttctggatgttcgtggacaacctggttctgaccgaggaagatagagccgtggccacaagattcctggaaatggaccccgtgaccatccagcacgtgagaggaagaaccacccagaacgccgtgcacgtgtggtccaatatccccgctgtgcggagcagacatagcgccctggtgtcccaagaggaactggctctgctggcccaggaccggcagcgggccaagcctccagctcaggagcctgccgccctggtgaagaactgcttcctcccccttagagagtactttaagtactttagcaccgagctgaccagcagcctg

SEQ ID NO: 54 - DNA, 642 bp, Chinchilla lanigera
  source 1..642: mol_type = genomic DNA
agccccgagcagatgtacaaaaccgtgcccgtgtggaagagacagccagtgcgggtgctctccctgttcggcaacatcaagcaggagctgaccagcctgggcttcctggaaaccggctctcaagccggcagactgagacatctgaaggacgtgacagatgtcgtgcggcgggacgtggaagagtggggacctttcgacctggtctacggcagcacccctgccagaggccacacatgtgatagaagccctggctggttcctgtttcacttccacagactgctgcaatacgccagacctcctccatctagcccccagccttttttctggatgttcgtggacaacctgctgctgacaagtgaagatcaggccaccgccacaagattcctggaaaccgagcctaccaccctgcaggacatcaggggacaggtgctgcacggcgccgtgcgggtgtggtccaacatccccgctgttcggagcagacactctgctctggcccctgaggaggaggccagcctgctcgcccacgtgaccagaggaacagagctgagcgcccgcggccctgcttctctggtgaagaactgcttcctgcccctgcgggaatacttcagctactttagccagaatagcctgcctctgtataag

SEQ ID NO: 55 - DNA, 639 bp, Choloepus didactylus
  source 1..639: mol_type = genomic DNA
tcccctctggagatgtacaagacagtgcccgcttggaagcgggaacctgtgcgcgtgctgtctctgttcggcgacatcaagaaagagctgctcagcctgggtttcctggagagcggatctggacaggagagactgagacacctggaagatgtgaccgacgtggtgcggcgggacgtcgaggaatggggcccctttgacctgctgtacggcgccacccctccactgggccacccctgtgaacaccctcctggctggtatgttttccaatttcatagactgctgcagtacgccagacctagaccaggcagcggccagcctttcttctggatgttcgtggacaacctggtcctcaccgccgaggaccgggctgtggcctctagattcctggagacagaccccgtgaccatccaggatgccagaggcagagccgtgcaggacgccgtgcgggtgtggtccaatctgcctgccgtgaaaagcagagatagcgccctggcccctgaggatgagctgagcctgagggcctgggacagacagagagccaagctgcccgcccagggccctgctgctctggtgaagaactgcttcctgcctctgcgggaatactttaagtacttcagcatggaactgaccagcagcctg

SEQ ID NO: 56 - DNA, 648 bp, Cricetulus griseus
  source 1..648: mol_type = genomic DNA
agcccccttgagatgtacaagacagtgtccgcctggaagcggcagcccatgagagtgctgtctctgttcggcaacatcgacaaggaactgaaaagcctgggcttcctggaaagcggcagcagaaccgaggaaggcagactgaagtacctggatgatgttacaaacgtggtgcgcagagatgtggaacggtggggacctttcgacctggtctacggcagcacccagccactgggatattcttgtgaccactgccctggatggtacatgttccagttccacagaatcctgcaatacgccagacctcatcctggcagccagcagccatttttctggatctttgtggacaacctgctgctgagcgaggacgatcaggtgaccgccgctagattcttccagaccgaggccgtgacactgcaggacgtgcggggcagggtgctgcaaaatgccgtgcgggtctggtctaatatccctggcctgaagtccaagcacagcgctctgacccctaaggaagagcagagcctggagggccacgtgcggaccagagccaaggtggccgcccagaaaaccgacgccctggtgaagaactgcctgctgcctctgagagagtactttaagtacttcagccagaaccccctccccctgtacaaa

SEQ ID NO: 57 - DNA, 639 bp, Equus asinus
  source 1..639: mol_type = genomic DNA
tcccctcttgagatgtacaagaccgtgcccgtgtggaagcgggaacctgtgcgggtgctctctctgttcggcgacatcaagaaagagctgacatctctgggcttcctggaaaacggcagcgaccccggcagactgaagcacctggacgacgttacaaacaccgtccgcagagatgtggaagagtggggccctttcgacctggtctacggctccacccctccactgggacacgcctgtgaccaccctccaggatggtatctgtttcagttccacagagtgctgcagtacgccagacccagacctggcagcccccaggccttcttctggatgttcgtggacaacctggtgctgaccgaagatgatagagctgtggccacacggttcctggagacagatcctgtgaccatccaggacgtgtgcggcagggccgtgcggaacgccgtgcatgtgtggagcaacatccctgctgtgaaaagcagacacagcgccctgttcagccaggaggaatcttttctcagagcccaagaccggcagagagccaagcctcctgccagaggccccgctaagctggtgaagaattgcttcctgcctctgagagagtacttcaagtactttagcaccgagttcaccagcagcctg

SEQ ID NO: 58 - DNA, 639 bp, Homo sapiens
  source 1..639: mol_type = genomic DNA
aatcctctggaaatgttcgaaaccgtgcctgtgtggcggagacagcctgtgcgggttctgagcctgttcgaggacatcaagaaagagctgacaagcctgggcttccttgagagcggcagcgaccccggacagctgaagcacgtggtggatgtgaccgacaccgtgcggaaggacgtggaagagtggggccctttcgacctggtctacggcgccacacctccactcggccacacctgtgatagaccccccagctggtatctgtttcagttccatagactgctgcaatacgccagacctaaacctggcagccccagaccattcttctggatgtttgtggacaacctggtgctgaacaaagaggatctggacgtggcctctagattcctggaaatggaacctgtgaccatccccgatgtgcacggcggaagcctgcagaatgccgtgcgggtgtggtccaacatccctgctatcagatccagacactgggccctggtcagcgaggaagagctgtctctgctggctcagaacaagcagagcagcaagctggccgccaagtggcctaccaagctggtgaagaactgcttcctgcctctgcgcgagtactttaagtacttctctacagagctgaccagctctctg

SEQ ID NO: 59 - DNA, 648 bp, Jaculus jaculus
  source 1..648: mol_type = genomic DNA
ggctctctggaagtgttcaagaccgtgcctgcttggaagcgggagcctatccgggtcctgagccttttcggcgacatcagaaaggaactgaccagcctgggatttctggaaagcggctctggcagcgaggagggcaaactgaagtacctggacgacgtgaccgacgtggtgcggagagatgtgggcaagtggggacctttcgacctgatgtacggctctacacagcctagatcccacagctgccacaactgccccgcttggtacatgtatcagtttcacagaatcctgcaatacgcccaacctaacagcaagagccagcagcccttcttctggatgttcgccgacaacctgctgctgtctgatgaggacgtgcgcaccgccaataggttcttcgagatgcagttcgtgatcctgcaggatgtttgtgatagagtgccacagaacgccgtgcgggtctggtccaacatccccgccctgagaagcagacatatggccctgacacctgaggaagaagagagcctgaaagctcaggtgaaggccaaagccaagctggccgtgcagggccctccctccctcgtgaagaactgcttcctgcctctgagagagtactttaagtacttcagcgagaatagcctgcctccatacccc

SEQ ID NO: 60 - DNA, 639 bp, Lemur catta
  source 1..639: mol_type = genomic DNA
tctcctcttgagatgtaccagaccgtgcctgtgtggaagagagagcctgtgcgggtgctgtccctcttcggcgacatcaagcgggagctgacctctctgggcttcctggaagatggcgccggccctggcggcctgaaatacctggacgacgttaccgacgtggtccgcagagatgtggaagagtggggccccttcgacctgctgtacggcgctacaccccctctgggacacacatgctaccaccctcctggctggtacctgtttcagttctgcagactgcggcaatacgcccggcccccaccaggaagccctagaccttttttctggatgttcgtggacaatctggtcctgacccaggaggacgtggccgccgctacaagattcctggaaatggaacctgtgaccatccaggatgtgtgtggcagagccctgcaggacgccaccagagtgtggtccaacatccccgccgtgcggagcaagcacagcggacccatcagcgaggaagagctgagcctgctcgcccaggatagacagagggccagactgcctccacggacacccgctcagctggtgaagaactgcttcctgcctctgagagagtactttaagtatttcagcgccgagctgaccagcagcctg

SEQ ID NO: 61 - DNA, 636 bp, Manis javanica
  source 1..636: mol_type = genomic DNA
agccccctggaaatgtacaaaaccgtgccagtttggaagagagagcccgtgcgggtgctgagcctgttcggcgacatcaagaaggaactgacctctctgggcttcctggaaaccggcagcgaccctggaaggctgaagcacctggacgatgtgaccgatgtggtgcggagagatgtgcgggagtggggcccctttgacctggtctacggctctacccctcctctgggacacgcctgtgaccatcctccaggctggtatctgttccagttccaccggatcctgcagtacagccggcctagactggcttctcagcagccttttttctggatgttcgtggacaacctggtcctgagagaagatgatagaaccaccgccacaagattcctcgagacagaccccgtgaccatccccgacgcctgcggcagagccatccacaacgccgtgcacgtgtggtccaacatccctgctgtgaaaagcagacacagcgccctggtgtccgaggaagagctgagcctgctggcccaagacaagcagcgggctaaggcccctacacagagacctgccaatctggtgaagaactgcttcctgcctctcagagagtactttaagtacttcaccgagctgacaagcagcctg

SEQ ID NO: 62 - DNA, 636 bp, Marmota monax
  source 1..636: mol_type = genomic DNA
tcccctcaggagatctacaaaaccgtgcctgcctggaagcgggagcctgtgcgcgtgctgagcctgttcggcgacattagaaaggaactgacaagcctgggcttcctggaacccggcagcgaggccggcagactgcggcatctggaagatgtgacagacatcgtgcggcgggacgtggaagagtggggccccttcgacctggtgtacggcagcacccctgccctcggccacgcctgcgaccactctccaggctggtatctgtttcagttccacagactgctgcaatacgccaggcctagagccggatccccacaagccttcttctggatgttcgtggacaacctgctgctgaccggcgatgagcaggccatcgccgctagattcctggaaaccgagcccgtgatcctgcaggatgttagaggaagcgccctgcagaacgccgtgcgggtctggaccaacatccccgctgtgaaatctagacacagcgcatctgaggaagagctgctgctgctggcccaggacggccagagaggaacactgcctgctcagggccctagcgcccttgtgaagaactgttttctgcctctgagagagtactttaagtacttcagccagaatgccctgcctctgtacaag

SEQ ID NO: 63 - DNA, 648 bp, Microtus ochrogaster
  source 1..648: mol_type = genomic DNA
aatcctgtgaagatgtacaagatcgtgtccgcctggaagcggcagccagtgcgggtgctgaacctgtttggcaaaatcgacaaggaactggagagcctgggcttcctggaaagcggaagcggcagcgaggaaggcagactgaagtacctggaggatgttacaaacgtggtgcggagagatgtggagagatggggccccttcgacctggtgtacggctctacccagcccctgggatattcttgcaacagatgtcctggctggtacatgttccagtttcacagaatcctgcagtacgcccagccacctagcggcagccagcagccttttttctggctgttcatggacaacctgcttctcaccgaggacgaccaggccacagccaccagattcttccaggtggaagccgtgaccctgcaagatgtgcggagcagagtgctgcaaaatgccgtgcgcgtctggtccaacatccccggactgaaaagcaagcactctgctctgacacctaaggagctgcagagcctggaaacccagacccggaccagaggcaagatggccgctcagaaagtggacctgctggtcaagacatgcctgctgcctctgagagagtacttcaagtacttcagccagaaccccctgcctctgtacaag

SEQ ID NO: 64 - DNA, 642 bp, Ochotona princeps
  source 1..642: mol_type = genomic DNA
caacctctggaaatctacgagacagtgcccgcctgcagacggaaacctctgagagtgctgagcctgttcgagcacatcgagaaggaactggctagcctgggatttctggaaaccggctctagccctggcagaatcagacatctggatgatgtgaccgacgtggtgcggagagatgttgagcagtggggccctttcgacctggtctacggcagcacaccccccctgggccacgccagcccacgcagcccaggatggtatctgtttcagttccacagaatgctgcaatacacccagcctaccgcctctacacagagaccttttttctggatgttcgtggacaatctgctgctcacccgggacgacctggtgacagccaccagattcctggaggtggaacctgctaccctgcaggacgtgcggggcagagtgctgcagggcgccatgcgggtgtggagcaacatccctgccgtgaacagcagacacaccgagctggcccctgaggccgagacagccctgctggcccagtcttgtagaagggccaaggcctccggcgagggccttgctagactgctgaagtcctgcttcctgcccctgcgggaatacttcaagtacttcccccagagccctctgcctctgagaaag

SEQ ID NO: 65 - DNA, 633 bp, Pteropus giganteus
  source 1..633: mol_type = genomic DNA
tcccctctggagatgtacaagaccgtgcccgtgtggaagcgcgagcctgtgcgggtgctgagcctcttcggcgacatcaaggccgagctggccagcctgggcttcctggaaagcggcagcggccctggcagactgaagcacctggacgacgtgaccaacacagtgcggaaggacgtggaacagtggggccctttcgacctggtctacggcgctacaccccccttcggccaggcctgcgacagaccccccggatggtatctgtttcagttccacagagtgctgcagtacgcccggcctggcggaccaagaccttttttctggatgttcgtggacaacctggttctgacagaagatgatagagccgtggcctctagattcctcgaggccgatcctgtcaccatcagagatgcctgtggcagagctctgcaagacgccgtgcacgtgtggtccaatatccctgctgtgcggagcagacattctgccctgctgcctcacgaggaactgtctctgctggctcgggacagacagcgggccagacaccccacccctggacctgccaggctggtgaaaaactgcttcctgccactgagagagtactttaaatacttcagcaccgagctgaccagcagcgtg

SEQ ID NO: 66 - DNA, 642 bp, Rattus rattus
  source 1..642: mol_type = genomic DNA
tcccctgtcgagatctacaagaccgtgtccgcctggaagcggcagcctgtgcgggtgctgagcctgttcggcaacatcgacaaggaactgaaaagcctgggattcctggaatctggcagcggctctgagggcggaacactgaagtacgtggaagatgtgaccaacgtggtgcggagagaggtggaaaagtggggcccttttgacctggtttacggcagcacccagcctctgggctacagctgcgacagatgccctggatggtacatgttccagttccacagaatcctgcaatacgccagacccagacaggattctcagcagccattcttctggatcttcgtggataacctgctgctgacagaggacgaccaggagacaaccgtgaggttcctgcagaccgaggctgtcaccctgcaggatgtgcggggcagagtgctgcagaacgccgtgcgggtgtggtccaacatccccggcctgaagagcaagcacgccgacctgacccctaaagaggaacagagcctcagaacacaagtgagaaccagaagcaagctggccgctcagaaagtggacagcctggtgaagtattgtctgctccccctgcgcgagtactttaagtacttcagccagaatagcctgcctctg

SEQ ID NO: 67 - DNA, 636 bp, Saimiri boliviensis
  source 1..636: mol_type = genomic DNA
tcccctctggaaatgttcgagacactgcctgtgtggcggagacaacctgtgcgcgtgctggccctgttcggcgacatcaagaaagagctgaccagcctgggcttcctgggatctggaagcgaccagggcagactgaagcacctggacgacgtgaccgatgtggtgcggaaggacgtcgaggaatggggccccttcgacctgctgtacggcgccacccctgcccctggccacgcctgcgaccatcctccagcttggtatctgtttcagttccacaggctgctgcagtacgccagacccagcggcagccccagaccttttttctggatgttcgtggaccacctgatgctgaacaaggaagatcaggatctggtttgtagattcctcgagatggaacaggccaccatccccgatgtgcggggcggcgtgctgcaaagcgccgtgcgggtgtggtccaacatccctgctatccggagcagacactgggccctgccatctgaggaagagttgtctgtgctgacacagaatagacagagcagcaagctgcctgcccagagacctacaaagctgctgaaaaactgcttcctgcccctgagagagtactttaagtacttcagcacagagctgacctccagcacc

SEQ ID NO: 68 - DNA, 630 bp, Sus scrofa
  source 1..630: mol_type = genomic DNA
tccccactggagatgtacaagaccgtgcccgtgtggaaaagagaacctgtgcgggtgctgagcctgttcggcgacatcaagaaggaactgatgagccttggattcctcgagaacggcagcgaggccggaacaagaaggcatctggacgatgtgaccaacgtggtgcggagagaggtggaagattggggcccttttgatctggtctacggcagcacacctcctctgggcagagccttcgaccggcctccaggctggtatctgtttcagttccacagaatcctgcagtacgccagacccagacctggctctcagcagcctttcttctggatgttcgtggacaacctggtgctgagcgaggacgaccgggccgtggccaccagattcctggaaaccgaccccgtgacagtgcaggacgcccacggccggaccgtgcgcaacgccgtgcacgtgtggtctaatatccctgctgtgcggagcagacacagcgccgtcgtgtcccaggaggaactgtctctgctggcccaagatagacagccccccgcccagagccctgctgctctggttaagaactgcttcctgcctctgagagagtacttcaagtactttagcgccgagctgaccagctgtctg

SEQ ID NO: 69 - DNA, 639 bp, Ursus arctos
  source 1..639: mol_type = genomic DNA
aatcctctggaaacctacaagaccgtgcccgtgtggaagcgggaacccgtgcgggtgctgagcctgttcggcgacatccggagagaactggtgtccctgggcttcctcgagaacggcagcgcccctggaagactgaagcacctggacgatgtgaccgacgtggtgcggcgcgacgtcgagggctggggccccttcgacctggtgtacggcagcacccctccaatcggccacgcctgcgaccatcctcctgtgtggtatctgtttcagttccacagaatcctgcagtacgccagacctagacccggatctagacaaccttttttctggatgttcgtggacaacctgctgctgagccaggacgaccagacagccgctacaagattcctggaggccgatcctgtgaccatccaggatgtttgtggcagagccgtgcggaacgccgtgcacgtgtggtccaacatccccgctgtgcggtctagacacgccgccctggccagctgcgaggaactgtctctgctggcccaagataggcagagaaccaagcctccagctcagggccctgcccagctggtcaagaactgcttcctgcctcttagagagtactttaaatacttcagcacagagctgaccagcagcctg

SEQ ID NO: 70 - DNA, 633 bp, Vombatus ursinus
  source 1..633: mol_type = genomic DNA
agacctctggaaatgtacaagaccatgcctgagtggaagcggaaacctattcaggtgctgagcctgttcggcgatatcgaggaagagctggtgaagttcggattcctggaaaacagctccggcaatggcaatctgaagcacctggacgacgtgaccgacgtgctcagaaaagacgttgaagaatggggaccttttgacctgatctacggctctacacctccaatcggccagatcagcgagcacccccccgtgtggtatttcctgcagtactacagagtgctgcaatacggcaagcccaagatggattccgagaagccattcttctggatgttcgtggacagcctggtgctgaccaaggatgatcgggaaatcgccagcagattcctggagacagatcctgtgaccatctacgaggtgtgcgacgagatgatcaagaacgccgtcctggtgtggtccaacatccccagcatgaaaagcaacaacagcgccctgacatctgattgggacctgcctctggtcgcccaggacatccagagcctgaacgacttcagcctgtggcctgcttctctggtgaacaagtgctttaaccctcttaaagagtacttcaagtgtttttctaaggaccacaccagc

SEQ ID NO: 71 - protein, 203 aa, synthetic construct
  REGION 1..203: note = synthetic sequence for use in compositions and/or methods
SPLEMYKTVPWKREPRVLSLFGDIKKLELTSLGFLEGSGRLKHLDDVTDVVRRDVEEWGPFDLVYGSTPPLGHCDSPGWYLFQFHRLLQYARPPGSPQPFFWMFVDNLLLTDDQATATRFLPGEGPEPVTLQPDVRGRVLQNAVRVWSNIPAVKSSHALAPEEELSLLAQQRALQGPALVKNCWFLPLREYFKYFSQTNSLPL

SEQ ID NO: 72 - protein, 211 aa, synthetic construct
  REGION 1..211: note = synthetic sequence for use in compositions and/or methods
SPLEMYKTVSAWKRQPMRVLSLFGNIDKELKSLGFLESGSGSEEGRLKYLEDVTNVVRRDVEWGPFDLVYGSTQPLGYSCDCPGWYMFQFHRILQYARPHPGSQQPFFWIFVDNLLLTEDDQVTAARFQGEAVTLQDVRGRVLQNAVRVWSNIPGLKSLSKHALTPKEEQSLAQVRTRAKLAAQKVDPLVKNCLLPLREYFKYFSQNSLPL

SEQ ID NO: 73 - protein, 207 aa, synthetic construct
  REGION 1..207: note = synthetic sequence for use in compositions and/or methods
SPLEMYKTVPVWKREPVRVLSLFGDIKKELTSLGFLEGSPGRLKHLDDVTDVVRRDVEEWGPFDLVYGSTPPLGHACDHPPGWYLFQFHRLLQYARPRPGSQPFFWMFVDNLVLTDRAATRFLGEGPTPVTIQDVCGRAQNAVVWSNIPAVKPSHSALEEELSLLAQDRQRAKPAQGGPALVKNCWFLPLREYFKYFSTELTSSLPL

SEQ ID NO: 74 - protein, 212 aa, synthetic construct
  REGION 1..212: note = synthetic sequence for use in compositions and/or methods
SPEIYKTVSAWKRQPVRVLSLFGNIDKELKSLGFLESGSGSEGGTLKYVEDVTNVVRRDVEKWGPFDLVYGSTQPLGYSCDRCPGWYMFQFHRILQYARPRQSQQPFFWIFVDNLLLTEDDQVTTVRFLQTEAVTLQDVRGRVLQNAVRVWSNIPGLKLSKHALTPKEEQSLQAQVRTRSKLAAQKVDPLVKNCLLPLREYFKYFSQNSLPL

SEQ ID NO: 75 - protein, 202 aa, synthetic construct
  REGION 1..202: note = synthetic sequence for use in compositions and/or methods
SPLEMYKTVPVWKREPVRVLSLFGDIKKELTSLGFLEGSDPGRLKHLDDVTDVVRRDVEEWGPFDLVYGSTPPLGHACDHPPGWYLFQFHRLQYARPRPGSQPFFWMFVDNLVLTDDRATRFLGEGPTPVTIQDCGRQNAVVWSNIPAVSRHSALSEELSLLAQDRQRAKPQGPALVKNCWFLPLREYFKYFSTELTSSLPL

SEQ ID NO: 76 - DNA, 609 bp, synthetic construct
  misc_feature 1..609: note = synthetic sequence for use in compositions and/or methods
  source 1..609: mol_type = other DNA
tctccactggaaatgtataagaccgtgccctggaagcgggaaccccgggtcctgtctctgttcggcgacatcaagaaactggagctgaccagcctcggcttcctggaaggcagcggaagactgaagcacctggacgacgttacagatgtggtgcgcagagatgtcgaggaatggggcccttttgatctggtgtacggcagcacacctccactgggccattgtgacagccctggctggtacctgttccagttccacagactgctgcaatacgccagaccccccggatctcctcagccttttttctggatgttcgtggacaacctgctgctgaccgacgaccaggccaccgccacacggttcctgcctggagagggccctgagcctgtgaccctgcaacctgatgtgaggggcagagtgctgcagaacgccgtgcgggtgtggagcaatatccccgccgtgaagtccagccacgccctggctcctgaggaagagctgagccttctggcccagcagagagccctgcagggcccagctctggtgaaaaactgctggttcctgcccctcagagagtactttaagtacttcagccagaccaactccctgcctctg

SEQ ID NO: 77 - DNA, 633 bp, synthetic construct
  misc_feature 1..633: note = synthetic sequence for use in compositions and/or methods
  source 1..633: mol_type = other DNA
tctccacttgagatgtacaagaccgtgtccgcctggaagcggcagcccatgcgggtgctgagcctgttcggcaacatcgacaaggaactgaaaagcctcggcttcctggagagcggctccggcagcgaggaaggcagactgaagtacctggaagatgtgacaaacgtggtgcggagagatgtggaatggggccctttcgacctggtgtacggctctacacagcctctgggctacagctgtgactgccctggatggtatatgttccaatttcacagaatcctgcaatacgccagaccccaccctggatctcagcagccttttttctggatcttcgtggataatctgctgctgacagaggacgaccaggtgaccgccgctagattccagggcgaggccgtgaccctgcaggacgtccgcggaagagtgctgcagaatgccgttcgggtctggtccaacatccccggcctgaagagcctgagcaagcacgccctgacccctaaagaagagcagagcctggcccaggtgaggaccagagccaagctggccgctcagaaagtggaccccctggtgaagaactgcctgctgccactgagagagtacttcaagtacttcagccagaacagcctgcctctg

SEQ ID NO: 78 - DNA, 621 bp, synthetic construct
  misc_feature 1..621: note = synthetic sequence for use in compositions and/or methods
  source 1..621: mol_type = other DNA
tccccactggaaatgtacaagaccgtgcccgtgtggaagcgggaacctgtgcgggtgctgagcctgtttggcgacatcaagaaagagctgacctccctgggattcctcgagggaagccccggcagactgaagcacctggacgacgtgaccgacgtggtcaggcgggacgtggaagagtggggcccttttgatctggtgtacggcagcacccctccactgggacacgcctgtgatcatcctcctggctggtatctgttccagttccacagactgctgcagtacgccagacctagacccggctctcagccttttttctggatgttcgtggacaatctggttctgacagatagagccgctacaagattcctgggcgagggccccacccctgtcacaatccaggacgtgtgcggcagagctcagaacgccgtggtgtggagcaacatccccgccgtgaaacctagccactctgccctggaggaagaactgtctctgctggcccaggatagacagcgggccaagcccgctcaaggcggcccagccctggtgaagaactgctggttcctgcctcttagagagtacttcaagtacttcagcaccgagctgacaagcagcctgcctctg

SEQ ID NO: 79 - DNA, 636 bp, synthetic construct
  misc_feature 1..636: note = synthetic sequence for use in compositions and/or methods
  source 1..636: mol_type = other DNA
agccctgagatctacaagaccgtgtccgcctggaagcggcagccagtgcgggtgctgagcctgttcggcaacatcgacaaggagctgaaaagcctcggcttcctggaatccggatctggaagcgagggcggcaccctgaaatacgtggaagatgtcacaaacgtggtgcgcagagatgtggaaaagtggggccctttcgacctggtctacggcagcacccagcctctgggctacagctgcgacagatgtcctggatggtatatgttccaatttcacagaatcctgcaatacgccagacccagacagagccagcagcccttcttctggatcttcgtggacaacctgctgctgacagaggacgatcaggtgacaacagtgcggttcctgcagaccgaggccgtgaccctgcaggacgtgaggggcagagttctgcagaatgccgtgagagtgtggtccaacatccccggcctgaagctgtctaagcacgccctgacccctaaggaagagcagtctctgcaggctcaggtgcggaccagaagcaagctggccgctcagaaagtggaccccctggtgaagaactgcctgctgcctctgagagagtactttaagtacttcagccaaaatagccttcctctg

SEQ ID NO: 80 - DNA, 606 bp, synthetic construct
  misc_feature 1..606: note = synthetic sequence for use in compositions and/or methods
  source 1..606: mol_type = other DNA
agccctcttgagatgtataagaccgtgcccgtgtggaaacgggagcctgtgagagtgctgtccctgttcggcgacatcaagaaggaactgaccagcctgggcttcctggaaggcagcgaccccggaagactgaagcacctggacgatgtgaccgacgtggtgaggcgggacgtggaagagtggggccctttcgacctggtgtacggcagcacccctcctctgggacatgcctgcgaccaccctccaggctggtacctgtttcaatttcacagactgcagtacgccagacctagacccggctctcagcccttcttctggatgttcgtggacaacctggtgctgaccgatgatagagccaccagattcctgggagagggccctacccctgttacaatccaggattgtggccgccagaacgccgtcgtgtggtccaacatccccgccgtgtctagacacagcgccctgagcgaggagctgtctctgctggcccaggacagacagcgggctaaacctcagggcccagctctggtcaagaattgctggttcctgcctctgcgggaatactttaagtacttcagcacagagctgacaagcagcctgcccctc

SEQ ID NO: 81 - protein, 12 aa, synthetic construct
  REGION 1..12: note = synthetic sequence for use in compositions and/or methods
ARTKQTARKSTG

SEQ ID NO: 82 - protein, 12 aa, synthetic construct
  REGION 1..12: note = synthetic sequence for use in compositions and/or methods
ARTAQTARKSTG

SEQ ID NO: 83 - protein, 12 aa, synthetic construct
  REGION 1..12: note = synthetic sequence for use in compositions and/or methods
QKASKGTARTTR

SEQ ID NO: 84 - DNA, 36 bp, synthetic construct
  misc_feature 1..36: note = synthetic sequence for use in compositions and/or methods
  source 1..36: mol_type = other DNA
gctcggaccaagcagaccgccagaaagagcaccggc

SEQ ID NO: 85 - DNA, 36 bp, synthetic construct
  misc_feature 1..36: note = synthetic sequence for use in compositions and/or methods
  source 1..36: mol_type = other DNA
gctcggaccgcccagaccgccagaaagagcaccggc

SEQ ID NO: 86 - DNA, 36 bp, synthetic construct
  misc_feature 1..36: note = synthetic sequence for use in compositions and/or methods
  source 1..36: mol_type = other DNA
cagaaggctagcaagggcaccgccagaaccacccgg

SEQ ID NO: 87 - protein, 30 aa, synthetic construct
  REGION 1..30: note = synthetic sequence for use in compositions and/or methods
ARTKQTARKSTGGKAPRKQLATKAARKSAP

SEQ ID NO: 88 - DNA, 90 bp, synthetic construct
  misc_feature 1..90: note = synthetic sequence for use in compositions and/or methods
  source 1..90: mol_type = other DNA
gccaggaccaaacaaactgccagaaagagcaccggggggaaagcgccccgaaaacagctggcgaccaaagcagcccgcaaaagcgcaccg

SEQ ID NO: 89 - protein, 27 aa, synthetic construct
  REGION 1..27: note = synthetic sequence for use in compositions and/or methods
SSGNSNANSRGPSFSSGLVPLSLRGSH

SEQ ID NO: 90 - protein, 15 aa, synthetic construct
  REGION 1..15: note = synthetic sequence for use in compositions and/or methods
GGGGSGGGGSGGGGS

SEQ ID NO: 91 - protein, 20 aa, synthetic construct
  REGION 1..20: note = synthetic sequence for use in compositions and/or methods
GGASSGAGSSSGGSAAGSGS

SEQ ID NO: 92 - protein, 26 aa, synthetic construct
  REGION 1..26: note = synthetic sequence for use in compositions and/or methods
GGASSGAGSSSGGSAAGSGSGGASSG

SEQ ID NO: 93 - protein, 32 aa, synthetic construct
  REGION 1..32: note = synthetic sequence for use in compositions and/or methods
GGASSGAGSSSGGSAAGSGSGGASSGAASSSA

SEQ ID NO: 94 - protein, 36 aa, synthetic construct
  REGION 1..36: note = synthetic sequence for use in compositions and/or methods
GGASSGAGSSSGGSAAGSGSSGASGSSGSASSGSGS

SEQ ID NO: 95 - protein, 38 aa, synthetic construct
  REGION 1..38: note = synthetic sequence for use in compositions and/or methods
GGASSGAGSSSGGSAAGSGSSGASGSSGSASSGSGSGG

SEQ ID NO: 96 - protein, 40 aa, synthetic construct
  REGION 1..40: note = synthetic sequence for use in compositions and/or methods
GGASSGAGSSSGGSAAGSGSSGASGSSGSASSGSGSGGSG

SEQ ID NO: 97 - protein, 42 aa, synthetic construct
  REGION 1..42: note = synthetic sequence for use in compositions and/or methods
GGASSGAGSSSGGSAAGSGSSGASGSSGSASSGSGSGGSGGS

SEQ ID NO: 98 - protein, 44 aa, synthetic construct
  REGION 1..44: note = synthetic sequence for use in compositions and/or methods
GGASSGAGSSSGGSAAGSGSSGASGSSGSASSGSGSGGSGGSSG

SEQ ID NO: 99 - protein, 46 aa, synthetic construct
  REGION 1..46: note = synthetic sequence for use in compositions and/or methods
GGASSGAGSSSGGSAAGSGSSGASGSSGSASSGSGSGGSGGSSGGS

SEQ ID NO: 100 - protein, 40 aa, synthetic construct
  REGION 1..40: note = synthetic sequence for use in compositions and/or methods
GGGSSGAPSPSGGSPAGSPTSTEEGTSESATPESGSGGSG

SEQ ID NO: 101 - DNA, 81 bp, synthetic construct
  misc_feature 1..81: note = synthetic sequence for use in compositions and/or methods
  source 1..81: mol_type = other DNA
tcttctggcaactctaatgctaacagcagaggacctagcttcagcagcggactggttccactgagcctgagaggcagccat

SEQ ID NO: 102 - DNA, 45 bp, synthetic construct
  misc_feature 1..45: note = synthetic sequence for use in compositions and/or methods
  source 1..45: mol_type = other DNA
ggaggtggcggcagcggaggaggaggttccggcggagggggttct

SEQ ID NO: 103 - DNA, 60 bp, synthetic construct
  misc_feature 1..60: note = synthetic sequence for use in compositions and/or methods
  source 1..60: mol_type = other DNA
ggaggtgcaagcagtggggcaggaagttcctcaggaggaagtgcggcgggatccggaagc

SEQ ID NO: 104 - DNA, 78 bp, synthetic construct
  misc_feature 1..78: note = synthetic sequence for use in compositions and/or methods
  source 1..78: mol_type = other DNA
ggaggtgcaagcagtggggcaggaagttcctcaggaggaagtgcggcgggatccggaagcggtggcgcatcaagtggc

SEQ ID NO: 105 - DNA, 96 bp, synthetic construct
  misc_feature 1..96: note = synthetic sequence for use in compositions and/or methods
  source 1..96: mol_type = other DNA
ggaggtgcaagcagtggggcaggaagttcctcaggaggaagtgcggcgggatccggaagcggtggcgcatcaagtggcgccgcaagtagcagtgcc

SEQ ID NO: 106 - DNA, 108 bp, synthetic construct
  misc_feature 1..108: note = synthetic sequence for use in compositions and/or methods
  source 1..108: mol_type = other DNA
ggcggagcaagctctggcgccggatcaagttctggcggatctgcagccggcagcggatcatccggtgctagtggctcaagcggatccgccagtagcggcagcggctca

SEQ ID NO: 107 - DNA, 114 bp, synthetic construct
  misc_feature 1..114: note = synthetic sequence for use in compositions and/or methods
  source 1..114: mol_type = other DNA
ggcggagcaagctctggcgccggatcaagttctggcggatctgcagccggcagcggatcatccggtgctagtggctcaagcggatccgccagtagcggcagcggctcaggcggt

SEQ ID NO: 108 - DNA, 120 bp, synthetic construct
  misc_feature 1..120: note = synthetic sequence for use in compositions and/or methods
  source 1..120: mol_type = other DNA
ggcggagcaagctctggcgccggatcaagttctggcggatctgcagccggcagcggatcatccggtgctagtggctcaagcggatccgccagtagcggcagcggctcaggcggtagcgga

SEQ ID NO: 109 - DNA, 126 bp, synthetic construct
  misc_feature 1..126: note = synthetic sequence for use in compositions and/or methods
  source 1..126: mol_type = other DNA
ggcggagcaagctctggcgccggatcaagttctggcggatctgcagccggcagcggatcatccggtgctagtggctcaagcggatccgccagtagcggcagcggctcaggcggtagcggaggctca

SEQ ID NO: 110 - DNA, 132 bp, synthetic construct
  misc_feature 1..132: note = synthetic sequence for use in compositions and/or methods
  source 1..132: mol_type = other DNA
ggcggagcaagctctggcgccggatcaagttctggcggatctgcagccggcagcggatcatccggtgctagtggctcaagcggatccgccagtagcggcagcggctcaggcggtagcggaggctcaagcggc

SEQ ID NO: 111 - DNA, 138 bp, synthetic construct
  misc_feature 1..138: note = synthetic sequence for use in compositions and/or methods
  source 1..138: mol_type = other DNA
ggcggagcaagctctggcgccggatcaagttctggcggatctgcagccggcagcggatcatccggtgctagtggctcaagcggatccgccagtagcggcagcggctcaggcggtagcggaggctcaagcggcggatcc

SEQ ID NO: 112 - DNA, 120 bp, synthetic construct
  misc_feature 1..120: note = synthetic sequence for use in compositions and/or methods
  source 1..120: mol_type = other DNA
ggcggaggaagcagcggcgccccttcaccatctggcggatctcctgccggcagccccacatccaccgaggaaggcacaagcgagtccgccacccctgaaagcggctcaggcggtagcgga

SEQ ID NO: 113 - protein, 16 aa, synthetic construct
  REGION 1..16: note = synthetic sequence for use in compositions and/or methods
SGSETPGTSESATPES

SEQ ID NO: 114 - protein, 24 aa, synthetic construct
  REGION 1..24: note = synthetic sequence for use in compositions and/or methods
SGGSSGSETPGTSESATPESSGGS

SEQ ID NO: 115 - protein, 32 aa, synthetic construct
  REGION 1..32: note = synthetic sequence for use in compositions and/or methods
SGGSSGGSSGSETPGTSESATPESSGGSSGGS

SEQ ID NO: 116 - protein, 34 aa, synthetic construct
  REGION 1..34: note = synthetic sequence for use in compositions and/or methods
GGPSSGAPPPSGGSPAGSPTSTEEGTSESATPES

SEQ ID NO: 117 - protein, 36 aa, synthetic construct
  REGION 1..36: note = synthetic sequence for use in compositions and/or methods
GGPSSGAPPPSGGSPAGSPTSTEEGTSESATPESGP

SEQ ID NO: 118 - protein, 38 aa, synthetic construct
  REGION 1..38: note = synthetic sequence for use in compositions and/or methods
GGPSSGAPPPSGGSPAGSPTSTEEGTSESATPESGPGT

SEQ ID NO: 119 - protein, 40 aa, synthetic construct
  REGION 1..40: note = synthetic sequence for use in compositions and/or methods
GGPSSGAPPPSGGSPAGSPTSTEEGTSESATPESGPGTST

SEQ ID NO: 120 - protein, 42 aa, synthetic construct
  REGION 1..42: note = synthetic sequence for use in compositions and/or methods
GGPSSGAPPPSGGSPAGSPTSTEEGTSESATPESGPGTSTGG

SEQ ID NO: 121 - protein, 44 aa, synthetic construct
  REGION 1..44: note = synthetic sequence for use in compositions and/or methods
GGPSSGAPPPSGGSPAGSPTSTEEGTSESATPESGPGTSTGGSG

SEQ ID NO: 122 - protein, 46 aa, synthetic construct
  REGION 1..46: note = synthetic sequence for use in compositions and/or methods
GGPSSGAPPPSGGSPAGSPTSTEEGTSESATPESGPGTSTGGSGGG

SEQ ID NO: 123 - protein, 48 aa, synthetic construct
  REGION 1..48: note = synthetic sequence for use in compositions and/or methods
GGPSSGAPPPSGGSPAGSPTSTEEGTSESATPESGPGTSTGGSGGGSG

SEQ ID NO: 124 - protein, 50 aa, synthetic construct
  REGION 1..50: note = synthetic sequence for use in compositions and/or methods
GGPSSGAPPPSGGSPAGSPTSTEEGTSESATPESGPGTSTGGSGGGSGGG

SEQ ID NO: 125 - protein, 52 aa, synthetic construct
  REGION 1..52: note = synthetic sequence for use in compositions and/or methods
GGPSSGAPPPSGGSPAGSPTSTEEGTSESATPESGPGTSTGGSGGGSGGGSG

SEQ ID NO: 126 - protein, 54 aa, synthetic construct
  REGION 1..54: note = synthetic sequence for use in compositions and/or methods
GGPSSGAPPPSGGSPAGSPTSTEEGTSESATPESGPGTSTGGSGGGSGGGSGGG

SEQ ID NO: 127 - protein, 80 aa, synthetic construct
  REGION 1..80: note = synthetic sequence for use in compositions and/or methods
GGPSSGAPPPSGGSPAGSPTSTEEGTSESATPESGPGTSTEPSEGSAPGSPAGSPTSTEEGTSTEPSEGSAPGTSTEPSE

SEQ ID NO: 128 - protein, 24 aa, synthetic construct
  REGION 1..24: note = synthetic sequence for use in compositions and/or methods
GGSKRTADGSEFESPKKKRKVGGS

SEQ ID NO: 129 - DNA, 48 bp, synthetic construct
  misc_feature 1..48: note = synthetic sequence for use in compositions and/or methods
  source 1..48: mol_type = other DNA
tccggctctgaaacccctggaacctccgagagcgccacacctgaaagc

SEQ ID NO: 130 - DNA, 72 bp, synthetic construct
  misc_feature 1..72: note = synthetic sequence for use in compositions and/or methods
  source 1..72: mol_type = other DNA
tccggcggatctagcggctctgaaacccctggcaccagcgagagcgccacacccgagagcagcggcggcagc

SEQ ID NO: 131 - DNA, 96 bp, synthetic construct
  misc_feature 1..96: note = synthetic sequence for use in compositions and/or methods
  source 1..96: mol_type = other DNA
tctggaggatctagcggaggatcctctggcagcgagacaccaggaacaagcgagtcagcaacaccagagagcagtggcggctccagtggcggatct

SEQ ID NO: 132 - DNA, 102 bp, synthetic construct
  misc_feature 1..102: note = synthetic sequence for use in compositions and/or methods
  source 1..102: mol_type = other DNA
ggcggacctagcagcggcgcccctcctccatctggcggatctcctgccggcagccccacatccaccgaggaaggcacaagcgagtccgccacccctgaaagc

SEQ ID NO: 133 - DNA, 108 bp, synthetic construct
  misc_feature 1..108: note = synthetic sequence for use in compositions and/or methods
  source 1..108: mol_type = other DNA
ggcggacctagcagcggcgcccctcctccatctggcggatctcctgccggcagccccacatccaccgaggaaggcacaagcgagtccgccacccctgaaagcggcccc

SEQ ID NO: 134 - DNA, 114 bp, synthetic construct
  misc_feature 1..114: note = synthetic sequence for use in compositions and/or methods
  source 1..114: mol_type = other DNA
ggcggacctagcagcggcgcccctcctccatctggcggatctcctgccggcagccccacatccaccgaggaaggcacaagcgagtccgccacccctgaaagcggccccggcacc

SEQ ID NO: 135 - DNA, 120 bp, synthetic construct
  misc_feature 1..120: note = synthetic sequence for use in compositions and/or methods
  source 1..120: mol_type = other DNA
ggcggacctagcagcggcgcccctcctccatctggcggatctcctgccggcagccccacatccaccgaggaaggcacaagcgagtccgccacccctgaaagcggccccggcaccagcaca

SEQ ID NO: 136 - DNA, 126 bp, synthetic construct
  misc_feature 1..126: note = synthetic sequence for use in compositions and/or methods
  source 1..126: mol_type = other DNA
ggcggacctagcagcggcgcccctcctccatctggcggatctcctgccggcagccccacatccaccgaggaaggcacaagcgagtccgccacccctgaaagcggccccggcaccagcacaggaggt

SEQ ID NO: 137 - DNA, 132 bp, synthetic construct
  misc_feature 1..132: note = synthetic sequence for use in compositions and/or methods
  source 1..132: mol_type = other DNA
ggcggacctagcagcggcgcccctcctccatctggcggatctcctgccggcagccccacatccaccgaggaaggcacaagcgagtccgccacccctgaaagcggccccggcaccagcacaggaggttccgga

SEQ ID NO: 138 - DNA, 138 bp, synthetic construct
  misc_feature 1..138: note = synthetic sequence for use in compositions and/or methods
  source 1..138: mol_type = other DNA
ggcggacctagcagcggcgcccctcctccatctggcggatctcctgccggcagccccacatccaccgaggaaggcacaagcgagtccgccacccctgaaagcggccccggcaccagcacaggaggttccggaggcggt

SEQ ID NO: 139 - DNA, 144 bp, synthetic construct
  misc_feature 1..144: note = synthetic sequence for use in compositions and/or methods
  source 1..144: mol_type = other DNA
ggcggacctagcagcggcgcccctcctccatctggcggatctcctgccggcagccccacatccaccgaggaaggcacaagcgagtccgccacccctgaaagcggccccggcaccagcacaggaggttccggaggcggttctggt

SEQ ID NO: 140 - DNA, 150 bp, synthetic construct
  misc_feature 1..150: note = synthetic sequence for use in compositions and/or methods
  source 1..150: mol_type = other DNA
ggcggacctagcagcggcgcccctcctccatctggcggatctcctgccggcagccccacatccaccgaggaaggcacaagcgagtccgccacccctgaaagcggccccggcaccagcacaggaggttccggaggcggttctggtggtgga

SEQ ID NO: 141 - DNA, 156 bp, synthetic construct
  misc_feature 1..156: note = synthetic sequence for use in compositions and/or methods
  source 1..156: mol_type = other DNA
ggcggacctagcagcggcgcccctcctccatctggcggatctcctgccggcagccccacatccaccgaggaaggcacaagcgagtccgccacccctgaaagcggccccggcaccagcacaggaggttccggaggcggttctggtggtggatctggc

SEQ ID NO: 142 - DNA, 162 bp, synthetic construct
  misc_feature 1..162: note = synthetic sequence for use in compositions and/or methods
  source 1..162: mol_type = other DNA
ggcggacctagcagcggcgcccctcctccatctggcggatctcctgccggcagccccacatccaccgaggaaggcacaagcgagtccgccacccctgaaagcggccccggcaccagcacaggaggttccggaggcggttctggtggtggatctggcggcgga

SEQ ID NO: 143 - DNA, 240 bp, synthetic construct
  misc_feature 1..240: note = synthetic sequence for use in compositions and/or methods
  source 1..240: mol_type = other DNA
ggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgag

SEQ ID NO: 144 - DNA, 72 bp, synthetic construct
  misc_feature 1..72: note = synthetic sequence for use in compositions and/or methods
  source 1..72: mol_type = other DNA
ggcggaagcaagcggaccgccgacggctctgaattcgagagccctaagaagaaaagaaaggtgggcggctcc

SEQ ID NO: 145 - protein, 19 aa, synthetic construct
  REGION 1..19: note = synthetic sequence for use in compositions and/or methods
ATNFSLLKQAGDVEENPGP

SEQ ID NO: 146 - DNA, 57 bp, synthetic construct
  misc_feature 1..57: note = synthetic sequence for use in compositions and/or methods
  source 1..57: mol_type = other DNA
gctacaaacttcagcctgctgaaacaggccggcgacgtcgaggaaaatcctggcccc

SEQ ID NO: 147 - protein, 21 aa, synthetic construct
  REGION 1..21: note = synthetic sequence for use in compositions and/or methods
GSGEGRGSLLTCGDVEENPGP

SEQ ID NO: 148 - DNA, 63 bp, synthetic construct
  misc_feature 1..63: note = synthetic sequence for use in compositions and/or methods
  source 1..63: mol_type = other DNA
ggatctggcgagggcagaggcagcctgctgacctgcggcgacgtggaagagaaccccggccct

SEQ ID NO: 149 - protein, 17 aa, synthetic construct
  REGION 1..17: note = synthetic sequence for use in compositions and/or methods
KRTADGSEFEPKKKRKV

SEQ ID NO: 150 - DNA, 51 bp, synthetic construct
  misc_feature 1..51: note = synthetic sequence for use in compositions and/or methods
  source 1..51: mol_type = other DNA
aagaggaccgccgacggcagcgagttcgagcccaagaaaaagcggaaggtg

SEQ ID NO: 151 - protein, 7 aa, synthetic construct
  REGION 1..7: note = synthetic sequence for use in compositions and/or methods
PKKKRKV

SEQ ID NO: 152 - DNA, 21 bp, synthetic construct
  misc_feature 1..21: note = synthetic sequence for use in compositions and/or methods
  source 1..21: mol_type = other DNA
cctaagaaaaagcggaaggtg

SEQ ID NO: 153 - protein, 232 aa, synthetic construct
  REGION 1..232: note = synthetic sequence for use in compositions and/or methods
SELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 154 - DNA, 696 bp, synthetic construct
  misc_feature 1..696: note = synthetic sequence for use in compositions and/or methods
  source 1..696: mol_type = other DNA
agcgagctgattaaggaaaacatgcacatgaagctgtatatggaaggcaccgtggacaaccaccatttcaagtgcaccagcgagggcgaaggcaagccctacgagggaacacagaccatgcggatcaaggtggtggaaggcggccctctgcccttcgccttcgacatcctcgccacctctttcctgtacggcagtaagacctttatcaaccacacccagggcatccccgatttcttcaagcagagcttccccgagggatttacctgggagagagtgaccacctacgaggacggcggcgtgctgacagccacccaggacaccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaac

SEQ ID NO: 155 - protein, 62 aa, synthetic construct
  REGION 1..62: note = synthetic sequence for use in compositions and/or methods
RTLVTFKDVFVDFTREEWKLLDTAQQIVYRNVMLENYKNLVSLGYQLTKPDVILRLEKGEEP

SEQ ID NO: 156 - DNA, 186 bp, synthetic construct
  misc_feature 1..186: note = synthetic sequence for use in compositions and/or methods
  source 1..186: mol_type = other DNA
agaaccctggtcaccttcaaagacgtgttcgtggacttcaccagagaagaatggaagctgctggataccgctcagcagatcgtgtacagaaacgtgatgctggaaaactacaagaatctggtgtccctgggctaccagctgaccaagcctgacgtgatcctgagactggaaaagggcgaggaaccc

SEQ ID NO: 157 - protein, 1807 aa, synthetic construct
  REGION 1..1807: note = synthetic sequence for use in compositions and/or methods
MARTKQTARKSTGGGPSSGAPPPSGGSPAGSPTSTEEGTSESATPESGPGTSTGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKVSGSETPGTSESATPESRTLVTFKDVFVDFTREEWKLLDTAQQIVYRNVMLENYKNLVSLGYQLTKPDVILRLEKGEEP

SEQ ID NO: 158 - protein, 1729 aa, synthetic construct
  REGION 1..1729: note = synthetic sequence for use in compositions and/or methods
MARTKQTARKSTGGGPSSGAPPPSGGSPAGSPTSTEEGTSESATPESGPGTSTGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKV

SEQ ID NO: 159 - protein, 1729 aa, synthetic construct
  REGION 1..1729: note = synthetic sequence for use in compositions and/or methods
MARTKQTARKSTGGGASSGAGSSSGGSAAGSGSSGASGSSGSASSGSGSGGSGGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKV

SEQ ID NO: 160 - protein, 1808 aa, synthetic construct
  REGION 1..1808: note = synthetic sequence for use in compositions and/or methods
MARTKQTARKSTGGGASSGAGSSSGGSAAGSGSSGASGSSGSASSGSGSGGSGMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKVSGSETPGTSESATPESRTLVTFKDVFVDFTREEWKLLDTAQQIVYRNVMLENYKNLVSLGYQLTKPDVILRLEKGEEP

SEQ ID NO: 161 - protein, 1728 aa, synthetic construct
  REGION 1..1728: note = synthetic sequence for use in compositions and/or methods
MARTKQTARKSTGGGASSGAGSSSGGSAAGSGSSGASGSSGSASSGSGSGGSGSPVEIYKTVSAWKRQPIRVLSLFGNIDKELKSLGFLESGSHSEGGTLKYVEDVTNVVRRDVEKWGPFDLLYGSTQPLGGSCDRCPGWYMFQFHRILQYARPRQESQPFFWIFMDNLLLTEDDQMTTVRFLQTEAVTLRDVRSRVLQNAVRVWSNIPGLKSKHEALSPKEEESLQGHVRTRSKLAAPKVDPLVKNCLLPLREYFKYFSQSSLPLGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKV

SEQ ID NO: 162 - protein, 1806 aa, synthetic construct
  REGION 1..1806: note = synthetic sequence for use in compositions and/or methods
MARTKQTARKSTGGGASSGAGSSSGGSAAGSGSSGASGSSGSASSGSGSGGSGSPVEIYKTVSAWKRQPIRVLSLFGNIDKELKSLGFLESGSHSEGGTLKYVEDVTNVVRRDVEKWGPFDLLYGSTQPLGGSCDRCPGWYMFQFHRILQYARPRQESQPFFWIFMDNLLLTEDDQMTTVRFLQTEAVTLRDVRSRVLQNAVRVWSNIPGLKSKHEALSPKEEESLQGHVRTRSKLAAPKVDPLVKNCLLPLREYFKYFSQSSLPLGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKVSGSETPGTSESATPESRTLVTFKDVFVDFTREEWKLLDTAQQIVYRNVMLENYKNLVSLGYQLTKPDVILRLEKGEEP

SEQ ID NO: 163 - protein, 566 aa, synthetic construct
  REGION 1..566: note = synthetic sequence for use in compositions and/or methods
MARTKQTARKSTGGGASSGAGSSSGGSAAGSGSSGASGSSGSASSGSGSGGSGSPVEIYKTVSAWKRQPIRVLSLFGNIDKELKSLGFLESGSHSEGGTLKYVEDVTNVVRRDVEKWGPFDLLYGSTQPLGGSCDRCPGWYMFQFHRILQYARPRQESQPFFWIFMDNLLLTEDDQMTTVRFLQTEAVTLRDVRSRVLQNAVRVWSNIPGLKSKHEALSPKEEESLQGHVRTRSKLAAPKVDPLVKNCLLPLREYFKYFSQSSLPLGGPSSGAPPPSGGSPAGSPTSTEEGTSESATPESGPGTSTEPSEGSAPGSPAGSPTSTEEGTSTEPSEGSAPGTSTEPSEKRTADGSEFESPKKKRKVGVPAAMAERPFQCRICMRNFSRSDHLSEHIRTHTGEKPFACDICGRKFAARSTRTNHTKIHTGSQKPFQCRICMRNFSRSDDLTRHIRTHTGEKPFACDICGRKFAQSSDLRRHTKIHTGSQKPFQCRICMRNFSQSGSLTRHIRTHTGEKPFACDICGRKFADRSHLARHTKIHLRQKDAARGSKRTADGSEFEPKKKRKV

SEQ ID NO: 164 - protein, 578 aa, synthetic construct
  REGION 1..578: note = synthetic sequence for use in compositions and/or methods
MARTKQTARKSTGGGASSGAGSSSGGSAAGSGSSGASGSSGSASSGSGSGGSGSPVEIYKTVSAWKRQPIRVLSLFGNIDKELKSLGFLESGSHSEGGTLKYVEDVTNVVRRDVEKWGPFDLLYGSTQPLGGSCDRCPGWYMFQFHRILQYARPRQESQPFFWIFMDNLLLTEDDQMTTVRFLQTEAVTLRDVRSRVLQNAVRVWSNIPGLKSKHEALSPKEEESLQGHVRTRSKLAAPKVDPLVKNCLLPLREYFKYFSQSSLPLGGPSSGAPPPSGGSPAGSPTSTEEGTSESATPESGPGTSTEPSEGSAPGSPAGSPTSTEEGTSTEPSEGSAPGTSTEPSEKRTADGSEFESPKKKRKVGVPAAMAERPFQCRICMNFSYKCCLSDHIRTHTGEKPFACDICGRKFARSANLTRHTKIHTGSQKPFQCRICMNFSRSDHLSAHIRTHTGEKPFACDICGRKFADRSALARHTKIHTHPRAPIPKPFQCRICMNFSIKHDLHRHIRTHTGEKPFACDICGRKFARSANLTRHTKIHLRQKDAARGSGGDAKSLTAWSKRTADGSEFEPKKKRKV

SEQ ID NO: 165 - protein, 576 aa, synthetic construct
  REGION 1..576: note = synthetic sequence for use in compositions and/or methods
MARTKQTARKSTGGGASSGAGSSSGGSAAGSGSSGASGSSGSASSGSGSGGSGSPVEIYKTVSAWKRQPIRVLSLFGNIDKELKSLGFLESGSHSEGGTLKYVEDVTNVVRRDVEKWGPFDLLYGSTQPLGGSCDRCPGWYMFQFHRILQYARPRQESQPFFWIFMDNLLLTEDDQMTTVRFLQTEAVTLRDVRSRVLQNAVRVWSNIPGLKSKHEALSPKEEESLQGHVRTRSKLAAPKVDPLVKNCLLPLREYFKYFSQSSLPLGGPSSGAPPPSGGSPAGSPTSTEEGTSESATPESGPGTSTEPSEGSAPGSPAGSPTSTEEGTSTEPSEGSAPGTSTEPSEKRTADGSEFESPKKKRKVGVPAAMAERPFQCRICMQNFSYPKDLARHIRTHTGEKPFACDICGRKFATSGNLTRHTKIHTGSQKPFQCRICMQNFSTSGSLSRHIRTHTGEKPFACDICGRKFAQSADRTKHTKIHTGSQKPFQCRICMNFSQSGDLTRHIRTHTGEKPFACDICGRKFAYRWLRNNHTKIHLRQKDAARGSGGDAKSLTAWSKRTADGSEFEPKKKRKV

SEQ ID NO: 166 - protein, 578 aa, synthetic construct
  REGION 1..578: note = synthetic sequence for use in compositions and/or methods
MARTKQTARKSTGGGASSGAGSSSGGSAAGSGSSGASGSSGSASSGSGSGGSGSPVEIYKTVSAWKRQPIRVLSLFGNIDKELKSLGFLESGSHSEGGTLKYVEDVTNVVRRDVEKWGPFDLLYGSTQPLGGSCDRCPGWYMFQFHRILQYARPRQESQPFFWIFMDNLLLTEDDQMTTVRFLQTEAVTLRDVRSRVLQNAVRVWSNIPGLKSKHEALSPKEEESLQGHVRTRSKLAAPKVDPLVKNCLLPLREYFKYFSQSSLPLGGPSSGAPPPSGGSPAGSPTSTEEGTSESATPESGPGTSTEPSEGSAPGSPAGSPTSTEEGTSTEPSEGSAPGTSTEPSEKRTADGSEFESPKKKRKVGVPAAMAERPFQCRICMNFSRSADLTRHIRTHTGEKPFACDICGRKFAQSGDLTRHTKIHTHPRAPIPKPFQCRICMNFSRSDHLSRHIRTHTGEKPFACDICGRKFADRSNRKTHTKIHTGSQKPFQCRICMNFSTSGSLSRHIRTHTGEKPFACDICGRKFAQNANLMKHTKIHLRQKDAARGSGGDAKSLTAWSKRTADGSEFEPKKKRKV

SEQ ID NO: 167 - protein, 577 aa, synthetic construct
  REGION 1..577: note = synthetic sequence for use in compositions and/or methods
MARTKQTARKSTGGGASSGAGSSSGGSAAGSGSSGASGSSGSASSGSGSGGSGSPVEIYKTVSAWKRQPIRVLSLFGNIDKELKSLGFLESGSHSEGGTLKYVEDVTNVVRRDVEKWGPFDLLYGSTQPLGGSCDRCPGWYMFQFHRILQYARPRQESQPFFWIFMDNLLLTEDDQMTTVRFLQTEAVTLRDVRSRVLQNAVRVWSNIPGLKSKHEALSPKEEESLQGHVRTRSKLAAPKVDPLVKNCLLPLREYFKYFSQSSLPLGGPSSGAPPPSGGSPAGSPTSTEEGTSESATPESGPGTSTEPSEGSAPGSPAGSPTSTEEGTSTEPSEGSAPGTSTEPSEKRTADGSEFESPKKKRKVGVPAAMAERPFQCRICMRNFSTSGHLSRHIRTHTGEKPFACDICGRKFAQSGHLSRHTKIHTGSQKPFQCRICMRNFSDRSHLTRHIRTHTGEKPFACDICGRKFAQSSDLRRHTKIHTGSQKPFQCRICMRNFSDRSYRNTHIRTHTGEKPFACDICGRKFARRSDLKRHTKIHLRQKDAARGSGGDAKSLTAWSKRTADGSEFEPKKKRKV

SEQ ID NO: 168 - protein, 576 aa, synthetic construct
  REGION 1..576: note = synthetic sequence for use in compositions and/or methods
MARTKQTARKSTGGGASSGAGSSSGGSAAGSGSSGASGSSGSASSGSGSGGSGSPVEIYKTVSAWKRQPIRVLSLFGNIDKELKSLGFLESGSHSEGGTLKYVEDVTNVVRRDVEKWGPFDLLYGSTQPLGGSCDRCPGWYMFQFHRILQYARPRQESQPFFWIFMDNLLLTEDDQMTTVRFLQTEAVTLRDVRSRVLQNAVRVWSNIPGLKSKHEALSPKEEESLQGHVRTRSKLAAPKVDPLVKNCLLPLREYFKYFSQSSLPLGGPSSGAPPPSGGSPAGSPTSTEEGTSESATPESGPGTSTEPSEGSAPGSPAGSPTSTEEGTSTEPSEGSAPGTSTEPSEKRTADGSEFESPKKKRKVGVPAAMAERPFQCRICMQNFSDRSNLSRHIRTHTGEKPFACDICGRKFALRQDLKRHTKIHTGSQKPFQCRICMQNFSDRSALSRHIRTHTGEKPFACDICGRKFAQSGDLTRHTKIHTGSQKPFQCRICMNFSRSANLARHIRTHTGEKPFACDICGRKFADSSDRKKHTKIHLRQKDAARGSGGDAKSLTAWSKRTADGSEFEPKKKRKV

SEQ ID NO: 169 - protein, 578 aa, synthetic construct
  REGION 1..578: note = synthetic sequence for use in compositions and/or methods
MARTKQTARKSTGGGASSGAGSSSGGSAAGSGSSGASGSSGSASSGSGSGGSGSPVEIYKTVSAWKRQPIRVLSLFGNIDKELKSLGFLESGSHSEGGTLKYVEDVTNVVRRDVEKWGPFDLLYGSTQPLGGSCDRCPGWYMFQFHRILQYARPRQESQPFFWIFMDNLLLTEDDQMTTVRFLQTEAVTLRDVRSRVLQNAVRVWSNIPGLKSKHEALSPKEEESLQGHVRTRSKLAAPKVDPLVKNCLLPLREYFKYFSQSSLPLGGPSSGAPPPSGGSPAGSPTSTEEGTSESATPESGPGTSTEPSEGSAPGSPAGSPTSTEEGTSTEPSEGSAPGTSTEPSEKRTADGSEFESPKKKRKVGVPAAMAERPFQCRICMNFSQSGHLARHIRTHTGEKPFACDICGRKFAQLTHLNSHTKIHTHPRAPIPKPFQCRICMNFSRSDNLARHIRTHTGEKPFACDICGRKFAMRHHLDDHTKIHTGSQKPFQCRICMNFSLRHHLTRHIRTHTGEKPFACDICGRKFADRSYRNTHTKIHLRQKDAARGSGGDAKSLTAWSKRTADGSEFEPKKKRKV

SEQ ID NO: 170 - DNA, 5427 bp, synthetic construct
  misc_feature 1..5427: note = synthetic sequence for use in compositions and/or methods
  source 1..5427: mol_type = other DNA
atggctcggaccaagcagaccgccagaaagagcaccggcggcggacctagcagcggcgcccctcctccatctggcggatctcctgccggcagccccacatccaccgaggaaggcacaagcgagtccgccacccctgaaagcggccccggcaccagcacaggacctatggaaatctacaagaccgtgtccgcttggaagcgccagcccgtgcgggtgctcagcctgtttagaaacatcgacaaggtgctgaaaagcctgggattcctggaatccggatctggcagcggcggcggcaccctgaagtacgtggaagatgtgacaaacgtggttaggcgggacgtcgagaagtggggcccttttgacctggtgtacggctccacccagcccctgggctccagctgtgaccggtgccccggctggtacatgttccagttccacagaatactgcagtacgccctgcctagacaggagagccagcggcctttcttctggatcttcatggacaacctgcttctgaccgaagatgatcaggagacaacaaccagattcctgcagaccgaagccgtgaccctgcaagacgtgcggggccgggactaccagaacgctatgagagtgtggtccaacatccccggcctgaagagcaagcacgcccccctgacccctaaagaagaagagtacctgcaggcccaggtccggtcccggagcaagctggacgcccctaaggtggacctgctggtgaagaactgcctgctgcctctgcgggaatacttcaagtacttctctcagaacagcctgcccctgggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtgtccggctctgaaacccctggaacctccgagagcgccacacctgaaagcagaaccctggtgaccttcaaggacgtgttcgtggacttcacccgcgaggaatggaagctcctggacaccgcccagcaaatcgtgtaccggaacgtgatgctggagaattacaagaacctggtgtctctgggctaccagctgacgaagcctgacgtcatcctgagactggaaaagggagaggagccttgataa

SEQ ID NO: 171 - DNA, 5193 bp, synthetic construct
  misc_feature 1..5193: note = synthetic sequence for use in compositions and/or methods
  source 1..5193: mol_type = other DNA
atggctcggaccaagcagaccgccagaaagagcaccggcggcggacctagcagcggcgcccctcctccatctggcggatctcctgccggcagccccacatccaccgaggaaggcacaagcgagtccgccacccctgaaagcggccccggcaccagcacaggacctatggaaatctacaagaccgtgtccgcttggaagcgccagcccgtgcgggtgctcagcctgtttagaaacatcgacaaggtgctgaaaagcctgggattcctggaatccggatctggcagcggcggcggcaccctgaagtacgtggaagatgtgacaaacgtggttaggcgggacgtcgagaagtggggcccttttgacctggtgtacggctccacccagcccctgggctccagctgtgaccggtgccccggctggtacatgttccagttccacagaatactgcagtacgccctgcctagacaggagagccagcggcctttcttctggatcttcatggacaacctgcttctgaccgaagatgatcaggagacaacaaccagattcctgcagaccgaagccgtgaccctgcaagacgtgcggggccgggactaccagaacgctatgagagtgtggtccaacatccccggcctgaagagcaagcacgcccccctgacccctaaagaagaagagtacctgcaggcccaggtccggtcccggagcaagctggacgcccctaaggtggacctgctggtgaagaactgcctgctgcctctgcgggaatacttcaagtacttctctcagaacagcctgcccctgggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtgtgataa

SEQ ID NO: 172 - DNA, 5193 bp, synthetic construct
  misc_feature 1..5193: note = synthetic sequence for use in compositions and/or methods
  source 1..5193: mol_type = other DNA
atggctcggaccaagcagaccgccagaaagagcaccggcggcggagcaagctctggcgccggatcaagttctggcggatctgcagccggcagcggatcatccggtgctagtggctcaagcggatccgccagtagcggcagcggctcaggcggtagcggaggacctatggaaatctacaagaccgtgtccgcttggaagcgccagcccgtgcgggtgctcagcctgtttagaaacatcgacaaggtgctgaaaagcctgggattcctggaatccggatctggcagcggcggcggcaccctgaagtacgtggaagatgtgacaaacgtggttaggcgggacgtcgagaagtggggcccttttgacctggtgtacggctccacccagcccctgggctccagctgtgaccggtgccccggctggtacatgttccagttccacagaatactgcagtacgccctgcctagacaggagagccagcggcctttcttctggatcttcatggacaacctgcttctgaccgaagatgatcaggagacaacaaccagattcctgcagaccgaagccgtgaccctgcaagacgtgcggggccgggactaccagaacgctatgagagtgtggtccaacatccccggcctgaagagcaagcacgcccccctgacccctaaagaagaagagtacctgcaggcccaggtccggtcccggagcaagctggacgcccctaaggtggacctgctggtgaagaactgcctgctgcctctgcgggaatacttcaagtacttctctcagaacagcctgcccctgggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtgtgataa

SEQ ID NO: 173 - DNA, 5430 bp, synthetic construct
  misc_feature 1..5430: note = synthetic sequence for use in compositions and/or methods
  source 1..5430: mol_type = other DNA
atggctcggaccaagcagaccgccagaaagagcaccggcggcggagcaagctctggcgccggatcaagttctggcggatctgcagccggcagcggatcatccggtgctagtggctcaagcggatccgccagtagcggcagcggctcaggcggtagcggaatgggacctatggaaatctacaagaccgtgtccgcttggaagcgccagcccgtgcgggtgctcagcctgtttagaaacatcgacaaggtgctgaaaagcctgggattcctggaatccggatctggcagcggcggcggcaccctgaagtacgtggaagatgtgacaaacgtggttaggcgggacgtcgagaagtggggcccttttgacctggtgtacggctccacccagcccctgggctccagctgtgaccggtgccccggctggtacatgttccagttccacagaatactgcagtacgccctgcctagacaggagagccagcggcctttcttctggatcttcatggacaacctgcttctgaccgaagatgatcaggagacaacaaccagattcctgcagaccgaagccgtgaccctgcaagacgtgcggggccgggactaccagaacgctatgagagtgtggtccaacatccccggcctgaagagcaagcacgcccccctgacccctaaagaagaagagtacctgcaggcccaggtccggtcccggagcaagctggacgcccctaaggtggacctgctggtgaagaactgcctgctgcctctgcgggaatacttcaagtacttctctcagaacagcctgcccctgggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtgtccggctctgaaacccctggaacctccgagagcgccacacctgaaagcagaaccctggtgaccttcaaggacgtgttcgtggacttcacccgcgaggaatggaagctcctggacaccgcccagcaaatcgtgtaccggaacgtgatgctggagaattacaagaacctggtgtctctgggctaccagctgacgaagcctgacgtcatcctgagactggaaaagggagaggagccttgataa

SEQ ID NO: 174 - DNA, 5190 bp, synthetic construct
  misc_feature 1..5190: note = synthetic sequence for use in compositions and/or methods
  source 1..5190: mol_type = other DNA
atggctcggaccaagcagaccgccagaaagagcaccggcggcggagcaagctctggcgccggatcaagttctggcggatctgcagccggcagcggatcatccggtgctagtggctcaagcggatccgccagtagcggcagcggctcaggcggtagcggatcccctgttgagatctacaagaccgtgtccgcctggaagcggcagccaatcagagtgctgagcctgttcggcaatattgacaaggaactgaagtctctgggcttcctggaaagcggcagccacagcgagggcggcacactgaagtacgtggaagatgtgaccaacgtggtgcggagagatgtggaaaagtggggacctttcgacctgctgtacggcagcacccagcctctgggcggaagctgcgacaggtgtcctggctggtacatgttccaatttcatagaatcctgcagtacgccagacctagacaggagtctcagcccttcttctggatcttcatggataacctgctgctcacagaggacgaccagatgaccaccgtgcggttcctgcaaacagaggccgtcaccctgcgcgacgtgagatctagagtgctgcagaacgccgtccgggtgtggagcaacatccccggtcttaaaagcaagcacgaggctctgtccccaaaagaggaagagagcctgcagggccacgtgcggaccagatctaagctggccgctcctaaagtggaccccctggtgaagaactgcctgctgcctctgagagagtactttaagtatttcagccagagcagcctgcccctgggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtgtgataa

SEQ ID NO: 175 - DNA, 5424 bp, synthetic construct
  misc_feature 1..5424: note = synthetic sequence for use in compositions and/or methods
  source 1..5424: mol_type = other DNA
atggctcggaccaagcagaccgccagaaagagcaccggcggcggagcaagctctggcgccggatcaagttctggcggatctgcagccggcagcggatcatccggtgctagtggctcaagcggatccgccagtagcggcagcggctcaggcggtagcggatcccctgttgagatctacaagaccgtgtccgcctggaagcggcagccaatcagagtgctgagcctgttcggcaatattgacaaggaactgaagtctctgggcttcctggaaagcggcagccacagcgagggcggcacactgaagtacgtggaagatgtgaccaacgtggtgcggagagatgtggaaaagtggggacctttcgacctgctgtacggcagcacccagcctctgggcggaagctgcgacaggtgtcctggctggtacatgttccaatttcatagaatcctgcagtacgccagacctagacaggagtctcagcccttcttctggatcttcatggataacctgctgctcacagaggacgaccagatgaccaccgtgcggttcctgcaaacagaggccgtcaccctgcgcgacgtgagatctagagtgctgcagaacgccgtccgggtgtggagcaacatccccggtcttaaaagcaagcacgaggctctgtccccaaaagaggaagagagcctgcagggccacgtgcggaccagatctaagctggccgctcctaaagtggaccccctggtgaagaactgcctgctgcctctgagagagtactttaagtatttcagccagagcagcctgcccctgggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtgtccggctctgaaacccctggaacctccgagagcgccacacctgaaagcagaaccctggtgaccttcaaggacgtgttcgtggacttcacccgcgaggaatggaagctcctggacaccgcccagcaaatcgtgtaccggaacgtgatgctggagaattacaagaacctggtgtctctgggctaccagctgacgaagcctgacgtcatcctgagactggaaaagggagaggagccttgataa

SEQ ID NO: 176 - DNA, 1704 bp, synthetic construct
  misc_feature 1..1704: note = synthetic sequence for use in compositions and/or methods
  source 1..1704: mol_type = other DNA
atggctcggaccaagcagaccgccagaaagagcaccggcggcggagcaagctctggcgccggatcaagttctggcggatctgcagccggcagcggatcatccggtgctagtggctcaagcggatccgccagtagcggcagcggctcaggcggtagcggatcccctgttgagatctacaagaccgtgtccgcctggaagcggcagccaatcagagtgctgagcctgttcggcaatattgacaaggaactgaagtctctgggcttcctggaaagcggcagccacagcgagggcggcacactgaagtacgtggaagatgtgaccaacgtggtgcggagagatgtggaaaagtggggacctttcgacctgctgtacggcagcacccagcctctgggcggaagctgcgacaggtgtcctggctggtacatgttccaatttcatagaatcctgcagtacgccagacctagacaggagtctcagcccttcttctggatcttcatggataacctgctgctcacagaggacgaccagatgaccaccgtgcggttcctgcaaacagaggccgtcaccctgcgcgacgtgagatctagagtgctgcagaacgccgtccgggtgtggagcaacatccccggtcttaaaagcaagcacgaggctctgtccccaaaagaggaagagagcctgcagggccacgtgcggaccagatctaagctggccgctcctaaagtggaccccctggtgaagaactgcctgctgcctctgagagagtactttaagtatttcagccagagcagcctgcccctgggaggacctagcagcggcgccccacctccaagcggaggctctccagctggcagccctaccagcacagaggaaggcacaagcgagagcgccacacctgagagcggccctggcacctccaccgagcccagcgagggctctgcccctggcagccccgccggaagccccacctctacagaagaaggcaccagcacagagccttctgaaggctctgcccctggaacatccaccgagcctagcgagaagcggactgccgatggatctgagtttgagagccctaagaaaaaaagaaaggttggggtacccgccgctatggctgagaggcccttccagtgtcgaatctgcatgcgtaacttcagtcgctccgaccacctgtccgagcacatccgcacccacaccggcgagaagccttttgcctgtgacatttgtgggaggaaatttgccgcccgctccacccgcaccaaccataccaagatacacacgggcagccaaaagcccttccagtgtcgaatctgcatgcgtaacttcagtcgctccgacgacctgacccgccacatccgcacccacaccggcgagaagccttttgcctgtgacatttgtgggaggaaatttgcccagtcctccgacctgcgccgccataccaagatacacacgggatctcagaagcccttccagtgtcgaatctgcatgcgtaacttcagtcagtccggctccctgacccgccacatccgcacccacaccggcgagaagccttttgcctgtgacatttgtgggaggaaatttgccgaccgctcccacctggcccgccataccaagatacacctgcgccaaaaagatgcggcccggggatccaagaggaccgccgacggcagcgagttcgagcccaagaaaaagcggaaggtgtagtaa

SEQ ID NO: 177 - DNA, 1740 bp, synthetic construct
  misc_feature 1..1740: note = synthetic sequence for use in compositions and/or methods
  source 1..1740: mol_type = other DNA
atggctcggaccaagcagaccgccagaaagagcaccggcggcggagcaagctctggcgccggatcaagttctggcggatctgcagccggcagcggatcatccggtgctagtggctcaagcggatccgccagtagcggcagcggctcaggcggtagcggatcccctgttgagatctacaagaccgtgtccgcctggaagcggcagccaatcagagtgctgagcctgttcggcaatattgacaaggaactgaagtctctgggcttcctggaaagcggcagccacagcgagggcggcacactgaagtacgtggaagatgtgaccaacgtggtgcggagagatgtggaaaagtggggacctttcgacctgctgtacggcagcacccagcctctgggcggaagctgcgacaggtgtcctggctggtacatgttccaatttcatagaatcctgcagtacgccagacctagacaggagtctcagcccttcttctggatcttcatggataacctgctgctcacagaggacgaccagatgaccaccgtgcggttcctgcaaacagaggccgtcaccctgcgcgacgtgagatctagagtgctgcagaacgccgtccgggtgtggagcaacatccccggtcttaaaagcaagcacgaggctctgtccccaaaagaggaagagagcctgcagggccacgtgcggaccagatctaagctggccgctcctaaagtggaccccctggtgaagaactgcctgctgcctctgagagagtactttaagtatttcagccagagcagcctgcccctgggaggacctagcagcggcgccccacctccaagcggaggctctccagctggcagccctaccagcacagaggaaggcacaagcgagagcgccacacctgagagcggccctggcacctccaccgagcccagcgagggctctgcccctggcagccccgccggaagccccacctctacagaagaaggcaccagcacagagccttctgaaggctctgcccctggaacatccaccgagcctagcgagaagcggactgccgatggatctgagtttgagagccctaagaaaaaaagaaaggttggagtgcccgccgccatggccgaacggcctttccagtgcagaatctgcatgaacttcagctacaagtgctgcctgtctgatcacatccggacccacaccggcgagaaaccttttgcctgtgacatctgcggaagaaagttcgcccggagcgctaatctgaccagacataccaagatccacacaggcagccagaaacctttccagtgccggatctgtatgaacttctctagaagcgaccacctgagcgcccacatcagaacacatacaggcgagaagccattcgcttgcgacatctgcggcagaaagtttgctgatagatctgccctggcccggcacaccaagatccacacccaccccagagcccctatccccaagcctttccaatgtcggatctgcatgaacttcagcatcaagcacgacctgcacagacacattcgcacccacaccggcgaaaaaccttttgcctgcgacatctgtggcagaaagttcgccaggtccgccaacctgacaagacacacaaagatccacctgagacagaaggacgccgctagaggcagcggcggagatgccaagagcctgaccgcctggtccaagaggaccgccgacggcagcgagttcgagcccaagaaaaagcggaaggtgtagtaa

SEQ ID NO: 178 - DNA, 1734 bp, synthetic construct
  misc_feature 1..1734: note = synthetic sequence for use in compositions and/or methods
  source 1..1734: mol_type = other DNA
atggctcggaccaagcagaccgccagaaagagcaccggcggcggagcaagctctggcgccggatcaagttctggcggatctgcagccggcagcggatcatccggtgctagtggctcaagcggatccgccagtagcggcagcggctcaggcggtagcggatcccctgttgagatctacaagaccgtgtccgcctggaagcggcagccaatcagagtgctgagcctgttcggcaatattgacaaggaactgaagtctctgggcttcctggaaagcggcagccacagcgagggcggcacactgaagtacgtggaagatgtgaccaacgtggtgcggagagatgtggaaaagtggggacctttcgacctgctgtacggcagcacccagcctctgggcggaagctgcgacaggtgtcctggctggtacatgttccaatttcatagaatcctgcagtacgccagacctagacaggagtctcagcccttcttctggatcttcatggataacctgctgctcacagaggacgaccagatgaccaccgtgcggttcctgcaaacagaggccgtcaccctgcgcgacgtgagatctagagtgctgcagaacgccgtccgggtgtggagcaacatccccggtcttaaaagcaagcacgaggctctgtccccaaaagaggaagagagcctgcagggccacgtgcggaccagatctaagctggccgctcctaaagtggaccccctggtgaagaactgcctgctgcctctgagagagtactttaagtatttcagccagagcagcctgcccctgggaggacctagcagcggcgccccacctccaagcggaggctctccagctggcagccctaccagcacagaggaaggcacaagcgagagcgccacacctgagagcggccctggcacctccaccgagcccagcgagggctctgcccctggcagccccgccggaagccccacctctacagaagaaggcaccagcacagagccttctgaaggctctgcccctggaacatccaccgagcctagcgagaagcggactgccgatggatctgagtttgagagccctaagaaaaaaagaaaggttggagtgcctgctgctatggccgagcggcctttccagtgtcggatctgtatgcaaaatttcagctaccccaaggacctggccagacacatccggacacacaccggcgaaaagccttttgcctgcgacatctgcggccgcaaattcgctacaagcggcaacctgacaagacatacaaaaatccacaccggctctcaaaagcctttccagtgcaggatctgcatgcagaacttctccaccagcggatctctgagcagacacattagaacccataccggcgagaagccattcgcctgtgacatctgcggcagaaagttcgcccagagcgccgatagaacaaagcacacaaagatccacaccggcagccagaaaccttttcagtgcagaatctgcatgaacttcagccagagcggcgatctgaccagacacatcagaacccacaccggagaaaagccctttgcctgcgatatctgtggccggaagttcgcctaccggtggctgcggaacaaccacaccaagatccacctgagacagaaggacgccgccagaggctctggcggcgacgccaagagcctgaccgcctggtccaagaggaccgccgacggcagcgagttcgagcccaagaaaaagcggaaggtgtagtaa

SEQ ID NO: 179 - DNA, 1740 bp, synthetic construct
  misc_feature 1..1740: note = synthetic sequence for use in compositions and/or methods
  source 1..1740: mol_type = other DNA
atggctcggaccaagcagaccgccagaaagagcaccggcggcggagcaagctctggcgccggatcaagttctggcggatctgcagccggcagcggatcatccggtgctagtggctcaagcggatccgccagtagcggcagcggctcaggcggtagcggatcccctgttgagatctacaagaccgtgtccgcctggaagcggcagccaatcagagtgctgagcctgttcggcaatattgacaaggaactgaagtctctgggcttcctggaaagcggcagccacagcgagggcggcacactgaagtacgtggaagatgtgaccaacgtggtgcggagagatgtggaaaagtggggacctttcgacctgctgtacggcagcacccagcctctgggcggaagctgcgacaggtgtcctggctggtacatgttccaatttcatagaatcctgcagtacgccagacctagacaggagtctcagcccttcttctggatcttcatggataacctgctgctcacagaggacgaccagatgaccaccgtgcggttcctgcaaacagaggccgtcaccctgcgcgacgtgagatctagagtgctgcagaacgccgtccgggtgtggagcaacatccccggtcttaaaagcaagcacgaggctctgtccccaaaagaggaagagagcctgcagggccacgtgcggaccagatctaagctggccgctcctaaagtggaccccctggtgaagaactgcctgctgcctctgagagagtactttaagtatttcagccagagcagcctgcccctgggaggacctagcagcggcgccccacctccaagcggaggctctccagctggcagccctaccagcacagaggaaggcacaagcgagagcgccacacctgagagcggccctggcacctccaccgagcccagcgagggctctgcccctggcagccccgccggaagccccacctctacagaagaaggcaccagcacagagccttctgaaggctctgcccctggaacatccaccgagcctagcgagaagcggactgccgatggatctgagtttgagagccctaagaaaaaaagaaaggttggcgttccagcagctatggcagaaagaccgtttcagtgccgcatttgcatgaacttttctcgctccgctgatcttacacgacatatccgtacgcataccggcgagaaaccctttgcttgtgatatttgtgggcgaaaatttgctcaaagcggtgatttaactaggcatacgaagatacatacccacccgcgggctcccataccaaaacctttccaatgccgcatttgtatgaattttagcagatcagatcatctctcccgacacattaggacgcatactggggagaaaccctttgcctgtgatatttgtggtaggaaatttgcagaccggagcaaccggaagacccacaccaagatccacaccggatctcagaaaccttttcagtgccggatctgcatgaacttcagcaccagcggcagcctgagccgccacatcagaacacacaccggcgagaagccctttgcttgtgatatctgcggaagaaaattcgctcagaacgccaacctgatgaagcacacaaagatccacctgagacagaaggacgccgctagaggctctggcggcgatgccaagagcctgaccgcctggtccaagaggaccgccgacggcagcgagttcgagcccaagaaaaagcggaaggtgtagtaa

SEQ ID NO: 180 - DNA, 1737 bp, synthetic construct
  misc_feature 1..1737: note = synthetic sequence for use in compositions and/or methods
  source 1..1737: mol_type = other DNA
atggctcggaccaagcagaccgccagaaagagcaccggcggcggagcaagctctggcgccggatcaagttctggcggatctgcagccggcagcggatcatccggtgctagtggctcaagcggatccgccagtagcggcagcggctcaggcggtagcggatcccctgttgagatctacaagaccgtgtccgcctggaagcggcagccaatcagagtgctgagcctgttcggcaatattgacaaggaactgaagtctctgggcttcctggaaagcggcagccacagcgagggcggcacactgaagtacgtggaagatgtgaccaacgtggtgcggagagatgtggaaaagtggggacctttcgacctgctgtacggcagcacccagcctctgggcggaagctgcgacaggtgtcctggctggtacatgttccaatttcatagaatcctgcagtacgccagacctagacaggagtctcagcccttcttctggatcttcatggataacctgctgctcacagaggacgaccagatgaccaccgtgcggttcctgcaaacagaggccgtcaccctgcgcgacgtgagatctagagtgctgcagaacgccgtccgggtgtggagcaacatccccggtcttaaaagcaagcacgaggctctgtccccaaaagaggaagagagcctgcagggccacgtgcggaccagatctaagctggccgctcctaaagtggaccccctggtgaagaactgcctgctgcctctgagagagtactttaagtatttcagccagagcagcctgcccctgggaggacctagcagcggcgccccacctccaagcggaggctctccagctggcagccctaccagcacagaggaaggcacaagcgagagcgccacacctgagagcggccctggcacctccaccgagcccagcgagggctctgcccctggcagccccgccggaagccccacctctacagaagaaggcaccagcacagagccttctgaaggctctgcccctggaacatccaccgagcctagcgagaagcggactgccgatggatctgagtttgagagccctaagaaaaaaagaaaggttggcgtgcccgccgccatggccgagagacctttccagtgcagaatctgcatgcgcaacttcagcaccagcggccacctgtctagacacatcagaacccacaccggcgaaaagcctttcgcctgtgatatctgcggcagaaagttcgctcaaagcggccacctgagcagacatacaaagatccacaccggaagccagaaaccatttcagtgtagaatctgcatgagaaacttctccgacagaagccacctgacaagacacattcggacccacacaggcgagaaacctttcgcctgcgacatctgcggccggaaattcgcccagagcagcgatctgcggagacacaccaagatccacacaggatctcagaagccctttcagtgccggatctgcatgcggaatttcagcgaccggagctacagaaacacccacatccggacacataccggcgaaaagccttttgcttgtgacatctgtggcagaaagttcgccagaaggtccgacctgaagcggcacaccaagatccacctgagacagaaggacgccgctagaggctctggcggagatgccaagagcctgaccgcctggtccaagaggaccgccgacggcagcgagttcgagcccaagaaaaagcggaaggtgtagtaa

SEQ ID NO: 181 - DNA, 1734 bp, synthetic construct
  misc_feature 1..1734: note = synthetic sequence for use in compositions and/or methods
  source 1..1734: mol_type = other DNA
atggctcggaccaagcagaccgccagaaagagcaccggcggcggagcaagctctggcgccggatcaagttctggcggatctgcagccggcagcggatcatccggtgctagtggctcaagcggatccgccagtagcggcagcggctcaggcggtagcggatcccctgttgagatctacaagaccgtgtccgcctggaagcggcagccaatcagagtgctgagcctgttcggcaatattgacaaggaactgaagtctctgggcttcctggaaagcggcagccacagcgagggcggcacactgaagtacgtggaagatgtgaccaacgtggtgcggagagatgtggaaaagtggggacctttcgacctgctgtacggcagcacccagcctctgggcggaagctgcgacaggtgtcctggctggtacatgttccaatttcatagaatcctgcagtacgccagacctagacaggagtctcagcccttcttctggatcttcatggataacctgctgctcacagaggacgaccagatgaccaccgtgcggttcctgcaaacagaggccgtcaccctgcgcgacgtgagatctagagtgctgcagaacgccgtccgggtgtggagcaacatccccggtcttaaaagcaagcacgaggctctgtccccaaaagaggaagagagcctgcagggccacgtgcggaccagatctaagctggccgctcctaaagtggaccccctggtgaagaactgcctgctgcctctgagagagtactttaagtatttcagccagagcagcctgcccctgggaggacctagcagcggcgccccacctccaagcggaggctctccagctggcagccctaccagcacagaggaaggcacaagcgagagcgccacacctgagagcggccctggcacctccaccgagcccagcgagggctctgcccctggcagccccgccggaagccccacctctacagaagaaggcaccagcacagagccttctgaaggctctgcccctggaacatccaccgagcctagcgagaagcggactgccgatggatctgagtttgagagccctaagaaaaaaagaaaggttggcgtgcccgccgccatggccgagagacctttccagtgccggatctgcatgcagaacttctccgatagaagcaacctgagccggcacatcagaacacacaccggcgagaagcctttcgcctgcgacatctgtggaaggaagttcgccctgcggcaggacctgaagcggcataccaagatccacacaggctctcagaagccatttcagtgcagaatctgcatgcaaaacttcagcgaccgctccgccctgtctagacacattcggacccacaccggagaaaagccctttgcctgtgatatctgtggcagaaagttcgcccagagcggagatctgaccagacatacaaagatccacacaggcagccagaaacctttccaatgtagaatctgcatgaacttcagcagatctgctaatctcgccagacacatccggacccacaccggcgaaaaaccttttgcctgcgacatctgcggcagaaaattcgctgatagcagcgaccggaaaaagcacacaaagatccacctgagacagaaggacgccgctagaggcagcggcggcgacgcaaagagcctgaccgcctggtccaagaggaccgccgacggcagcgagttcgagcccaagaaaaagcggaaggtgtagtaa

SEQ ID NO: 182 - DNA, 1740 bp, synthetic construct
  misc_feature 1..1740: note = synthetic sequence for use in compositions and/or methods
  source 1..1740: mol_type = other DNA
atggctcggaccaagcagaccgccagaaagagcaccggcggcggagcaagctctggcgccggatcaagttctggcggatctgcagccggcagcggatcatccggtgctagtggctcaagcggatccgccagtagcggcagcggctcaggcggtagcggatcccctgttgagatctacaagaccgtgtccgcctggaagcggcagccaatcagagtgctgagcctgttcggcaatattgacaaggaactgaagtctctgggcttcctggaaagcggcagccacagcgagggcggcacactgaagtacgtggaagatgtgaccaacgtggtgcggagagatgtggaaaagtggggacctttcgacctgctgtacggcagcacccagcctctgggcggaagctgcgacaggtgtcctggctggtacatgttccaatttcatagaatcctgcagtacgccagacctagacaggagtctcagcccttcttctggatcttcatggataacctgctgctcacagaggacgaccagatgaccaccgtgcggttcctgcaaacagaggccgtcaccctgcgcgacgtgagatctagagtgctgcagaacgccgtccgggtgtggagcaacatccccggtcttaaaagcaagcacgaggctctgtccccaaaagaggaagagagcctgcagggccacgtgcggaccagatctaagctggccgctcctaaagtggaccccctggtgaagaactgcctgctgcctctgagagagtactttaagtatttcagccagagcagcctgcccctgggaggacctagcagcggcgccccacctccaagcggaggctctccagctggcagccctaccagcacagaggaaggcacaagcgagagcgccacacctgagagcggccctggcacctccaccgagcccagcgagggctctgcccctggcagccccgccggaagccccacctctacagaagaaggcaccagcacagagccttctgaaggctctgcccctggaacatccaccgagcctagcgagaagcggactgccgatggatctgagtttgagagccctaagaaaaaaagaaaggttggtgttcccgcagctatggcagaaagaccctttcagtgcaggatttgtatgaacttttctcaatctgggcatttggcccgccatatacgcacacatactggggaaaagcccttcgcttgtgatatttgtggacggaagtttgcacaacttacgcatctcaattcccatactaagattcatacgcacccccgcgcaccaattccgaaaccattccaatgtcgtatatgtatgaacttttcacgctcagataatttggctaggcatattagaacgcataccggtgagaaaccgtttgcgtgcgatatttgcggccgaaaatttgctatgcgtcatcatttggacgatcatactaaaattcatactgggagccaaaagcccttccaatgtcgcatatgtatgaatttcagcctgcggcatcacctgaccagacacatcagaacacatacaggcgaaaagccattcgcctgcgacatctgtggcagaaagttcgcagatagatcctaccgcaacacccacaccaagatccacctgagacagaaggacgctgccaggggcagcggaggagatgccaagagcctgaccgcctggtccaagaggaccgccgacggcagcgagttcgagcccaagaaaaagcggaaggtgtagtaa

SEQ ID NO: 183 - DNA, 1759 bp, synthetic construct
  misc_feature 1..1759: note = synthetic sequence for use in compositions and/or methods
  source 1..1759: mol_type = other DNA
gacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattctgcagtcgacggtaccgcgggcccgggatccaccggtc

SEQ ID NO: 184 - DNA, 235 bp, synthetic construct
  misc_feature 1..235: note = synthetic sequence for use in compositions and/or methods
  source 1..235: mol_type = other DNA
gtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagaggtgtcgtga

SEQ ID NO: 185 - skipped

SEQ ID NO: 186 - DNA, 601 bp, synthetic construct
  misc_feature 1..601: note = synthetic sequence for use in compositions and/or methods
  source 1..601: mol_type = other DNA
gcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcat

SEQ ID NO: 187 - DNA, 56 bp, synthetic construct
  misc_feature 1..56: note = synthetic sequence for use in compositions and/or methods
  source 1..56: mol_type = other DNA
aataaaggaaatttattttcattgcaatagtgtgttggaattttttgtgtctctca

SEQ ID NO: 188 - protein, 2335 aa, synthetic construct
  REGION 1..2335: note = synthetic sequence for use in compositions and/or methods
MNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKVSGSETPGTSESATPESRTLVTFKDVFVDFTREEWKLLDTAQQIVYRNVMLENYKNLVSLGYQLTKPDVILRLEKGEEPATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 189 - protein, 1712 aa, synthetic construct
  REGION 1..1712: note = synthetic sequence for use in compositions and/or methods
MPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKVSGSETPGTSESATPESRTLVTFKDVFVDFTREEWKLLDTAQQIVYRNVMLENYKNLVSLGYQLTKPDVILRLEKGEEPATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 190 - protein, 1928 aa, synthetic construct
  REGION 1..1928: note = synthetic sequence for use in compositions and/or methods
MGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKVATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 191 - protein, 1185 aa, synthetic construct
  REGION 1..1185: note = synthetic sequence for use in compositions and/or methods
MNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEKRTADGSEFESPKKKRKVGVPAAMAERPFQCRICMNFSYKCCLSDHIRTHTGEKPFACDICGRKFARSANLTRHTKIHTGSQKPFQCRICMNFSRSDHLSAHIRTHTGEKPFACDICGRKFADRSALARHTKIHTHPRAPIPKPFQCRICMNFSIKHDLHRHIRTHTGEKPFACDICGRKFARSANLTRHTKIHLRQKDAARGSGGDAKSLTAWSKRTADGSEFEPKKKRKVSGSETPGTSESATPESRTLVTFKDVFVDFTREEWKLLDTAQQIVYRNVMLENYKNLVSLGYQLTKPDVILRLEKGEEPATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 192 - protein, 1183 aa, synthetic construct
  REGION 1..1183: note = synthetic sequence for use in compositions and/or methods
MNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEKRTADGSEFESPKKKRKVGVPAAMAERPFQCRICMQNFSYPKDLARHIRTHTGEKPFACDICGRKFATSGNLTRHTKIHTGSQKPFQCRICMQNFSTSGSLSRHIRTHTGEKPFACDICGRKFAQSADRTKHTKIHTGSQKPFQCRICMNFSQSGDLTRHIRTHTGEKPFACDICGRKFAYRWLRNNHTKIHLRQKDAARGSGGDAKSLTAWSKRTADGSEFEPKKKRKVSGSETPGTSESATPESRTLVTFKDVFVDFTREEWKLLDTAQQIVYRNVMLENYKNLVSLGYQLTKPDVILRLEKGEEPATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 193 - protein, 1185 aa, synthetic construct
  REGION 1..1185: note = synthetic sequence for use in compositions and/or methods
MNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEKRTADGSEFESPKKKRKVGVPAAMAERPFQCRICMNFSRSADLTRHIRTHTGEKPFACDICGRKFAQSGDLTRHTKIHTHPRAPIPKPFQCRICMNFSRSDHLSRHIRTHTGEKPFACDICGRKFADRSNRKTHTKIHTGSQKPFQCRICMNFSTSGSLSRHIRTHTGEKPFACDICGRKFAQNANLMKHTKIHLRQKDAARGSGGDAKSLTAWSKRTADGSEFEPKKKRKVSGSETPGTSESATPESRTLVTFKDVFVDFTREEWKLLDTAQQIVYRNVMLENYKNLVSLGYQLTKPDVILRLEKGEEPATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 194 - protein, 1184 aa, synthetic construct
  REGION 1..1184: note = synthetic sequence for use in compositions and/or methods
MNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEKRTADGSEFESPKKKRKVGVPAAMAERPFQCRICMRNFSTSGHLSRHIRTHTGEKPFACDICGRKFAQSGHLSRHTKIHTGSQKPFQCRICMRNFSDRSHLTRHIRTHTGEKPFACDICGRKFAQSSDLRRHTKIHTGSQKPFQCRICMRNFSDRSYRNTHIRTHTGEKPFACDICGRKFARRSDLKRHTKIHLRQKDAARGSGGDAKSLTAWSKRTADGSEFEPKKKRKVSGSETPGTSESATPESRTLVTFKDVFVDFTREEWKLLDTAQQIVYRNVMLENYKNLVSLGYQLTKPDVILRLEKGEEPATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 195 - protein, 1183 aa, synthetic construct
  REGION 1..1183: note = synthetic sequence for use in compositions and/or methods
MNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEKRTADGSEFESPKKKRKVGVPAAMAERPFQCRICMQNFSDRSNLSRHIRTHTGEKPFACDICGRKFALRQDLKRHTKIHTGSQKPFQCRICMQNFSDRSALSRHIRTHTGEKPFACDICGRKFAQSGDLTRHTKIHTGSQKPFQCRICMNFSRSANLARHIRTHTGEKPFACDICGRKFADSSDRKKHTKIHLRQKDAARGSGGDAKSLTAWSKRTADGSEFEPKKKRKVSGSETPGTSESATPESRTLVTFKDVFVDFTREEWKLLDTAQQIVYRNVMLENYKNLVSLGYQLTKPDVILRLEKGEEPATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 196 - protein, 1185 aa, synthetic construct
  REGION 1..1185: note = synthetic sequence for use in compositions and/or methods
MNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEKRTADGSEFESPKKKRKVGVPAAMAERPFQCRICMNFSQSGHLARHIRTHTGEKPFACDICGRKFAQLTHLNSHTKIHTHPRAPIPKPFQCRICMNFSRSDNLARHIRTHTGEKPFACDICGRKFAMRHHLDDHTKIHTGSQKPFQCRICMNFSLRHHLTRHIRTHTGEKPFACDICGRKFADRSYRNTHTKIHLRQKDAARGSGGDAKSLTAWSKRTADGSEFEPKKKRKVSGSETPGTSESATPESRTLVTFKDVFVDFTREEWKLLDTAQQIVYRNVMLENYKNLVSLGYQLTKPDVILRLEKGEEPATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 197 - protein, 1188 aa, synthetic construct
  REGION 1..1188: note = synthetic sequence for use in compositions and/or methods
MNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEKRTADGSEFESPKKKRKVGVPAAMAERPFQCRICMRNFSRSDDLTRHIRTHTGEKPFACDICGRKFAQSSDLRRHTKIHTGSQKPFQCRICMRNFSDRSHLTRHIRTHTGEKPFACDICGRKFARLDWLPMHTKIHTHPRAPIPKPFQCRICMRNFSTSGNLTRHIRTHTGEKPFACDICGRKFADLTTLRKHTKIHLRQKDAARGSGGDAKSLTAWSKRTADGSEFEPKKKRKVSGSETPGTSESATPESRTLVTFKDVFVDFTREEWKLLDTAQQIVYRNVMLENYKNLVSLGYQLTKPDVILRLEKGEEPATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 198 - protein, 1188 aa, synthetic construct
  REGION 1..1188: note = synthetic sequence for use in compositions and/or methods
MNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEKRTADGSEFESPKKKRKVGVPAAMAERPFQCRICMRNFSTSGNLTRHIRTHTGEKPFACDICGRKFALSQDLNRHTKIHTHPRAPIPKPFQCRICMRNFSDRSALSRHIRTHTGEKPFACDICGRKFARNDDRKKHTKIHTGSQKPFQCRICMRNFSQSGNLARHIRTHTGEKPFACDICGRKFAQRIDLTRHTKIHLRQKDAARGSGGDAKSLTAWSKRTADGSEFEPKKKRKVSGSETPGTSESATPESRTLVTFKDVFVDFTREEWKLLDTAQQIVYRNVMLENYKNLVSLGYQLTKPDVILRLEKGEEPATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 199 - protein, 1184 aa, synthetic construct
  REGION 1..1184: note = synthetic sequence for use in compositions and/or methods
MNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEKRTADGSEFESPKKKRKVGVPAAMAERPFQCRICMRNFSDRSALARHIRTHTGEKPFACDICGRKFAMACCRYAHTKIHTGSQKPFQCRICMRNFSDRSDLSRHIRTHTGEKPFACDICGRKFARRTDLRRHTKIHTGSQKPFQCRICMRNFSSEADRSRHIRTHTGEKPFACDICGRKFADRSNLTRHTKIHLRQKDAARGSGGDAKSLTAWSKRTADGSEFEPKKKRKVSGSETPGTSESATPESRTLVTFKDVFVDFTREEWKLLDTAQQIVYRNVMLENYKNLVSLGYQLTKPDVILRLEKGEEPATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 200 - protein, 1184 aa, synthetic construct
  REGION 1..1184: note = synthetic sequence for use in compositions and/or methods
MNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEKRTADGSEFESPKKKRKVGVPAAMAERPFQCRICMRNFSRSDHLSEHIRTHTGEKPFACDICGRKFAYSWRLSQHTKIHTGSQKPFQCRICMRNFSLRHHLTRHIRTHTGEKPFACDICGRKFAQSGTRKTHTKIHTGSQKPFQCRICMRNFSRSDVLSKHIRTHTGEKPFACDICGRKFARSDDRIKHTKIHLRQKDAARGSGGDAKSLTAWSKRTADGSEFEPKKKRKVSGSETPGTSESATPESRTLVTFKDVFVDFTREEWKLLDTAQQIVYRNVMLENYKNLVSLGYQLTKPDVILRLEKGEEPATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 201 - protein, 1188 aa, synthetic construct
  REGION 1..1188: note = synthetic sequence for use in compositions and/or methods
MNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEKRTADGSEFESPKKKRKVGVPAAMAERPFQCRICMQNFSWNSDLRKHIRTHTGEKPFACDICGRKFAQSGNLARHTKIHTGSQKPFQCRICMQNFSQSSDLSRHIRTHTGEKPFACDICGRKFAHRSTRNRHTKIHTHPRAPIPKPFQCRICMQNFSRSDDLSRHIRTHTGEKPFACDICGRKFAQSANRTKHTKIHLRQKDAARGSGGDAKSLTAWSKRTADGSEFEPKKKRKVSGSETPGTSESATPESRTLVTFKDVFVDFTREEWKLLDTAQQIVYRNVMLENYKNLVSLGYQLTKPDVILRLEKGEEPATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 202 - protein, 1184 aa, synthetic construct
  REGION 1..1184: note = synthetic sequence for use in compositions and/or methods
MNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEKRTADGSEFESPKKKRKVGVPAAMAERPFQCRICMRNFSRSADLTRHIRTHTGEKPFACDICGRKFADRSALARHTKIHTGSQKPFQCRICMRNFSQSGHLARHIRTHTGEKPFACDICGRKFAQKGTLGEHTKIHTGSQKPFQCRICMRNFSIRSTLRDHIRTHTGEKPFACDICGRKFAHRSSLRRHTKIHLRQKDAARGSGGDAKSLTAWSKRTADGSEFEPKKKRKVSGSETPGTSESATPESRTLVTFKDVFVDFTREEWKLLDTAQQIVYRNVMLENYKNLVSLGYQLTKPDVILRLEKGEEPATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 203 - protein, 2033 aa, synthetic construct
  REGION 1..2033: note = synthetic sequence for use in compositions and/or methods
MARTKQTARKSTGGGGGSGGGGSGGGGSGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKVSGSETPGTSESATPESRTLVTFKDVFVDFTREEWKLLDTAQQIVYRNVMLENYKNLVSLGYQLTKPDVILRLEKGEEPATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 204 - protein, 2034 aa, synthetic construct
  REGION 1..2034: note = synthetic sequence for use in compositions and/or methods
MARTKQTARKSTGSGSETPGTSESATPESGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKVSGSETPGTSESATPESRTLVTFKDVFVDFTREEWKLLDTAQQIVYRNVMLENYKNLVSLGYQLTKPDVILRLEKGEEPATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 205 - protein, 2058 aa, synthetic construct
  REGION 1..2058: note = synthetic sequence for use in compositions and/or methods
MARTKQTARKSTGGGPSSGAPPPSGGSPAGSPTSTEEGTSESATPESGPGTSTGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKVSGSETPGTSESATPESRTLVTFKDVFVDFTREEWKLLDTAQQIVYRNVMLENYKNLVSLGYQLTKPDVILRLEKGEEPATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 206 - protein, 2098 aa, synthetic construct
  REGION 1..2098: note = synthetic sequence for use in compositions and/or methods
MARTKQTARKSTGGGPSSGAPPPSGGSPAGSPTSTEEGTSESATPESGPGTSTEPSEGSAPGSPAGSPTSTEEGTSTEPSEGSAPGTSTEPSEGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKVSGSETPGTSESATPESRTLVTFKDVFVDFTREEWKLLDTAQQIVYRNVMLENYKNLVSLGYQLTKPDVILRLEKGEEPATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 207 - protein, 1955 aa, synthetic construct
  REGION 1..1955: note = synthetic sequence for use in compositions and/or methods
MARTKQTARKSTGGGGGSGGGGSGGGGSGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKVATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 208 - protein, 1956 aa, synthetic construct
  REGION 1..1956: note = synthetic sequence for use in compositions and/or methods
MARTKQTARKSTGSGSETPGTSESATPESGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKVATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 209 - protein, 1980 aa, synthetic construct
  REGION 1..1980: note = synthetic sequence for use in compositions and/or methods
MARTKQTARKSTGGGPSSGAPPPSGGSPAGSPTSTEEGTSESATPESGPGTSTGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKVATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 210 - protein, 2020 aa, synthetic construct
  REGION 1..2020: note = synthetic sequence for use in compositions and/or methods
MARTKQTARKSTGGGPSSGAPPPSGGSPAGSPTSTEEGTSESATPESGPGTSTEPSEGSAPGSPAGSPTSTEEGTSTEPSEGSAPGTSTEPSEGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKVATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 211 - protein, 1173 aa, synthetic construct
  REGION 1..1173: note = synthetic sequence for use in compositions and/or methods
MNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEKRTADGSEFESPKKKRKVGVPAAMAERPFQCRICMRNFSRSDHLSEHIRTHTGEKPFACDICGRKFAARSTRTNHTKIHTGSQKPFQCRICMRNFSRSDDLTRHIRTHTGEKPFACDICGRKFAQSSDLRRHTKIHTGSQKPFQCRICMRNFSQSGSLTRHIRTHTGEKPFACDICGRKFADRSHLARHTKIHLRQKDAARGSKRTADGSEFEPKKKRKVSGSETPGTSESATPESRTLVTFKDVFVDFTREEWKLLDTAQQIVYRNVMLENYKNLVSLGYQLTKPDVILRLEKGEEPATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 212 - protein, 2104 aa, synthetic construct
  REGION 1..2104: note = synthetic sequence for use in compositions and/or methods
MKRTADGSEFESPKKKRKVARTKQTARKSTGSGGSSGSETPGTSESATPESSGGSARTKQTARKSTGSGGSSGGSSGSETPGTSESATPESSGGSSGGSGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKVSGSETPGTSESATPESRTLVTFKDVFVDFTREEWKLLDTAQQIVYRNVMLENYKNLVSLGYQLTKPDVILRLEKGEEPATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 213 - protein, 2026 aa, synthetic construct
  REGION 1..2026: note = synthetic sequence for use in compositions and/or methods
MKRTADGSEFESPKKKRKVARTKQTARKSTGSGGSSGSETPGTSESATPESSGGSARTKQTARKSTGSGGSSGGSSGSETPGTSESATPESSGGSSGGSGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKVATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 214 - protein, 2086 aa, synthetic construct
  REGION 1..2086: note = synthetic sequence for use in compositions and/or methods
MARTKQTARKSTGGGSKRTADGSEFESPKKKRKVGGSARTKQTARKSTGSGGSSGGSSGSETPGTSESATPESSGGSSGGSGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKVSGSETPGTSESATPESRTLVTFKDVFVDFTREEWKLLDTAQQIVYRNVMLENYKNLVSLGYQLTKPDVILRLEKGEEPATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 215 - protein, 2008 aa, synthetic construct
  REGION 1..2008: note = synthetic sequence for use in compositions and/or methods
MARTKQTARKSTGGGSKRTADGSEFESPKKKRKVGGSARTKQTARKSTGSGGSSGGSSGSETPGTSESATPESSGGSSGGSGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKVATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 216 - protein, 2050 aa, synthetic construct
  REGION 1..2050: note = synthetic sequence for use in compositions and/or methods
MARTKQTARKSTGSGGSSGGSSGSETPGTSESATPESSGGSSGGSGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKVSGSETPGTSESATPESRTLVTFKDVFVDFTREEWKLLDTAQQIVYRNVMLENYKNLVSLGYQLTKPDVILRLEKGEEPATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 217 - protein, 1972 aa, synthetic construct
  REGION 1..1972: note = synthetic sequence for use in compositions and/or methods
MARTKQTARKSTGSGGSSGGSSGSETPGTSESATPESSGGSSGGSGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKVATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 218 - protein, 2076 aa, synthetic construct
  REGION 1..2076: note = synthetic sequence for use in compositions and/or methods
MKRTADGSEFESPKKKRKVARTKQTARKSTGGGPSSGAPPPSGGSPAGSPTSTEEGTSESATPESGPGTSTGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKVSGSETPGTSESATPESRTLVTFKDVFVDFTREEWKLLDTAQQIVYRNVMLENYKNLVSLGYQLTKPDVILRLEKGEEPATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 219 - protein, 1998 aa, synthetic construct
  REGION 1..1998: note = synthetic sequence for use in compositions and/or methods
MKRTADGSEFESPKKKRKVARTKQTARKSTGGGPSSGAPPPSGGSPAGSPTSTEEGTSESATPESGPGTSTGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKVATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 220 - protein, 2058 aa, synthetic construct
  REGION 1..2058: note = synthetic sequence for use in compositions and/or methods
MQKASKGTARTTRGGPSSGAPPPSGGSPAGSPTSTEEGTSESATPESGPGTSTGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKVSGSETPGTSESATPESRTLVTFKDVFVDFTREEWKLLDTAQQIVYRNVMLENYKNLVSLGYQLTKPDVILRLEKGEEPATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 221 - protein, 1980 aa, synthetic construct
  REGION 1..1980: note = synthetic sequence for use in compositions and/or methods
MQKASKGTARTTRGGPSSGAPPPSGGSPAGSPTSTEEGTSESATPESGPGTSTGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKVATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 222 - protein, 2058 aa, synthetic construct
  REGION 1..2058: note = synthetic sequence for use in compositions and/or methods
MARTAQTARKSTGGGPSSGAPPPSGGSPAGSPTSTEEGTSESATPESGPGTSTGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKVSGSETPGTSESATPESRTLVTFKDVFVDFTREEWKLLDTAQQIVYRNVMLENYKNLVSLGYQLTKPDVILRLEKGEEPATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 223 - protein, 1980 aa, synthetic construct
  REGION 1..1980: note = synthetic sequence for use in compositions and/or methods
MARTAQTARKSTGGGPSSGAPPPSGGSPAGSPTSTEEGTSESATPESGPGTSTGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKVATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 224 - protein, 550 aa, synthetic construct
  REGION 1..550: note = synthetic sequence for use in compositions and/or methods
MKRTADGSEFESPKKKRKVGVPAAMAERPFQCRICMRNFSRSDHLSEHIRTHTGEKPFACDICGRKFAARSTRTNHTKIHTGSQKPFQCRICMRNFSRSDDLTRHIRTHTGEKPFACDICGRKFAQSSDLRRHTKIHTGSQKPFQCRICMRNFSQSGSLTRHIRTHTGEKPFACDICGRKFADRSHLARHTKIHLRQKDAARGSKRTADGSEFEPKKKRKVSGSETPGTSESATPESRTLVTFKDVFVDFTREEWKLLDTAQQIVYRNVMLENYKNLVSLGYQLTKPDVILRLEKGEEPATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 225 - protein, 1974 aa, synthetic construct
  REGION 1..1974: note = synthetic sequence for use in compositions and/or methods
MARTKQTARKSTGGGPSSGAPPPSGGSPAGSPTSTEEGTSESATPESGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKVATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 226 - protein, 1974 aa, synthetic construct; identical to SEQ ID NO: 225
  REGION 1..1974: note = synthetic sequence for use in compositions and/or methods

SEQ ID NO: 227 - protein, 1978 aa, synthetic construct
  REGION 1..1978: note = synthetic sequence for use in compositions and/or methods
MARTKQTARKSTGGGPSSGAPPPSGGSPAGSPTSTEEGTSESATPESGPGTGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKVATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 228 - protein, 1980 aa, synthetic construct
  REGION 1..1980: note = synthetic sequence for use in compositions and/or methods
MARTKQTARKSTGGGGSSGAPSPSGGSPAGSPTSTEEGTSESATPESGSGGSGGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKVATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 229 - protein, 1980 aa, synthetic construct
  REGION 1..1980: note = synthetic sequence for use in compositions and/or methods
MARTKQTARKSTGGGASSGAGSSSGGSAAGSGSSGASGSSGSASSGSGSGGSGGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKVATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 230 - protein, 1982 aa, synthetic construct
  REGION 1..1982: note = synthetic sequence for use in compositions and/or methods
MARTKQTARKSTGGGPSSGAPPPSGGSPAGSPTSTEEGTSESATPESGPGTSTGGGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKVATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 231 - protein, 1984 aa, synthetic construct
  REGION 1..1984: note = synthetic sequence for use in compositions and/or methods
MARTKQTARKSTGGGPSSGAPPPSGGSPAGSPTSTEEGTSESATPESGPGTSTGGSGGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKVATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 232 - protein, 1986 aa, synthetic construct
  REGION 1..1986: note = synthetic sequence for use in compositions and/or methods
MARTKQTARKSTGGGPSSGAPPPSGGSPAGSPTSTEEGTSESATPESGPGTSTGGSGGGGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKVATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 233 - protein, 1988 aa, synthetic construct
  REGION 1..1988: note = synthetic sequence for use in compositions and/or methods
MARTKQTARKSTGGGPSSGAPPPSGGSPAGSPTSTEEGTSESATPESGPGTSTGGSGGGSGGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKVATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 234 - protein, 1990 aa, synthetic construct
  REGION 1..1990: note = synthetic sequence for use in compositions and/or methods
MARTKQTARKSTGGGPSSGAPPPSGGSPAGSPTSTEEGTSESATPESGPGTSTGGSGGGSGGGGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKVATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 235 - protein, 1992 aa, synthetic construct
  REGION 1..1992: note = synthetic sequence for use in compositions and/or methods
MARTKQTARKSTGGGPSSGAPPPSGGSPAGSPTSTEEGTSESATPESGPGTSTGGSGGGSGGGSGGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKVATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 236 - protein, 1994 aa, synthetic construct
  REGION 1..1994: note = synthetic sequence for use in compositions and/or methods
MARTKQTARKSTGGGPSSGAPPPSGGSPAGSPTSTEEGTSESATPESGPGTSTGGSGGGSGGGSGGGGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKVATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 237 - protein, 2059 aa, synthetic construct
  REGION 1..2059: note = synthetic sequence for use in compositions and/or methods
MARTKQTARKSTGGGASSGAGSSSGGSAAGSGSSGASGSSGSASSGSGSGGSGMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKVSGSETPGTSESATPESRTLVTFKDVFVDFTREEWKLLDTAQQIVYRNVMLENYKNLVSLGYQLTKPDVILRLEKGEEPATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 238 - protein, 2257 aa, synthetic construct
  REGION 1..2257: note = synthetic sequence for use in compositions and/or methods
MNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKVATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 239 - protein, 1917 aa, synthetic construct
  REGION 1..1917: note = synthetic sequence for use in compositions and/or methods
MSPLEMYKTVPWKREPRVLSLFGDIKKLELTSLGFLEGSGRLKHLDDVTDVVRRDVEEWGPFDLVYGSTPPLGHCDSPGWYLFQFHRLLQYARPPGSPQPFFWMFVDNLLLTDDQATATRFLPGEGPEPVTLQPDVRGRVLQNAVRVWSNIPAVKSSHALAPEEELSLLAQQRALQGPALVKNCWFLPLREYFKYFSQTNSLPLGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKVATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 240 - protein, 1925 aa, synthetic construct
  REGION 1..1925: note = synthetic sequence for use in compositions and/or methods
MSPLEMYKTVSAWKRQPMRVLSLFGNIDKELKSLGFLESGSGSEEGRLKYLEDVTNVVRRDVEWGPFDLVYGSTQPLGYSCDCPGWYMFQFHRILQYARPHPGSQQPFFWIFVDNLLLTEDDQVTAARFQGEAVTLQDVRGRVLQNAVRVWSNIPGLKSLSKHALTPKEEQSLAQVRTRAKLAAQKVDPLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKVATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 241 - protein, 1916 aa, synthetic construct
  REGION 1..1916: note = synthetic sequence for use in compositions and/or methods
MSPLEMYKTVPVWKREPVRVLSLFGDIKKELTSLGFLEGSDPGRLKHLDDVTDVVRRDVEEWGPFDLVYGSTPPLGHACDHPPGWYLFQFHRLQYARPRPGSQPFFWMFVDNLVLTDDRATRFLGEGPTPVTIQDCGRQNAVVWSNIPAVSRHSALSEELSLLAQDRQRAKPQGPALVKNCWFLPLREYFKYFSTELTSSLPLGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKVATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 242 - protein, 1921 aa, synthetic construct
  REGION 1..1921: note = synthetic sequence for use in compositions and/or methods
MSPLEMYKTVPVWKREPVRVLSLFGDIKKELTSLGFLEGSPGRLKHLDDVTDVVRRDVEEWGPFDLVYGSTPPLGHACDHPPGWYLFQFHRLLQYARPRPGSQPFFWMFVDNLVLTDRAATRFLGEGPTPVTIQDVCGRAQNAVVWSNIPAVKPSHSALEEELSLLAQDRQRAKPAQGGPALVKNCWFLPLREYFKYFSTELTSSLPLGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKVATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 243 - protein, 1926 aa, synthetic construct
  REGION 1..1926: note = synthetic sequence for use in compositions and/or methods
MSPEIYKTVSAWKRQPVRVLSLFGNIDKELKSLGFLESGSGSEGGTLKYVEDVTNVVRRDVEKWGPFDLVYGSTQPLGYSCDRCPGWYMFQFHRILQYARPRQSQQPFFWIFVDNLLLTEDDQVTTVRFLQTEAVTLQDVRGRVLQNAVRVWSNIPGLKLSKHALTPKEEQSLQAQVRTRSKLAAQKVDPLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKVATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 244 - protein, 1927 aa, synthetic construct
  REGION 1..1927: note = synthetic sequence for use in compositions and/or methods
MSPVEIYKTVSAWKRQPIRVLSLFGNIDKELKSLGFLESGSHSEGGTLKYVEDVTNVVRRDVEKWGPFDLLYGSTQPLGGSCDRCPGWYMFQFHRILQYARPRQESQPFFWIFMDNLLLTEDDQMTTVRFLQTEAVTLRDVRSRVLQNAVRVWSNIPGLKSKHEALSPKEEESLQGHVRTRSKLAAPKVDPLVKNCLLPLREYFKYFSQSSLPLGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKVATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 245 - protein, 1927 aa, synthetic construct
  REGION 1..1927: note = synthetic sequence for use in compositions and/or methods
MSPLEMYKTVPVWKREPVRVLSLFGDIKKELTSLGFLESGSGPGRLRHLDDVTDVVRRDVEEWGPFDLTYGSTPPLGHTCDHPPGWYLFQFHRVLQYARPRRGSQQPFFWMFVDNLVLTEEDRAVATRFLEMDPVTIQHVRGRTTQNAVHVWSNIPAVRSRHSALVSQEELALLAQDRQRAKPPAQEPAALVKNCFLPLREYFKYFSTELTSSLGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKVATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 246 - protein, 1928 aa, synthetic construct
  REGION 1..1928: note = synthetic sequence for use in compositions and/or methods
MSPEQMYKTVPVWKRQPVRVLSLFGNIKQELTSLGFLETGSQAGRLRHLKDVTDVVRRDVEEWGPFDLVYGSTPARGHTCDRSPGWFLFHFHRLLQYARPPPSSPQPFFWMFVDNLLLTSEDQATATRFLETEPTTLQDIRGQVLHGAVRVWSNIPAVRSRHSALAPEEEASLLAHVTRGTELSARGPASLVKNCFLPLREYFSYFSQNSLPLYKGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKVATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 247 - protein, 1927 aa, synthetic construct
  REGION 1..1927: note = synthetic sequence for use in compositions and/or methods
MSPLEMYKTVPAWKREPVRVLSLFGDIKKELLSLGFLESGSGQERLRHLEDVTDVVRRDVEEWGPFDLLYGATPPLGHPCEHPPGWYVFQFHRLLQYARPRPGSGQPFFWMFVDNLVLTAEDRAVASRFLETDPVTIQDARGRAVQDAVRVWSNLPAVKSRDSALAPEDELSLRAWDRQRAKLPAQGPAALVKNCFLPLREYFKYFSMELTSSLGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKVATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 248 - protein, 1930 aa, synthetic construct
  REGION 1..1930: note = synthetic sequence for use in compositions and/or methods
MSPLEMYKTVSAWKRQPMRVLSLFGNIDKELKSLGFLESGSRTEEGRLKYLDDVTNVVRRDVERWGPFDLVYGSTQPLGYSCDHCPGWYMFQFHRILQYARPHPGSQQPFFWIFVDNLLLSEDDQVTAARFFQTEAVTLQDVRGRVLQNAVRVWSNIPGLKSKHSALTPKEEQSLEGHVRTRAKVAAQKTDALVKNCLLPLREYFKYFSQNPLPLYKGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKVATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 249 - protein, 1927 aa, synthetic construct
  REGION 1..1927: note = synthetic sequence for use in compositions and/or methods
MSPLEMYKTVPVWKREPVRVLSLFGDIKKELTSLGFLENGSDPGRLKHLDDVTNTVRRDVEEWGPFDLVYGSTPPLGHACDHPPGWYLFQFHRVLQYARPRPGSPQAFFWMFVDNLVLTEDDRAVATRFLETDPVTIQDVCGRAVRNAVHVWSNIPAVKSRHSALFSQEESFLRAQDRQRAKPPARGPAKLVKNCFLPLREYFKYFSTEFTSSLGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKVATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 250 - protein, 1927 aa, synthetic construct
  REGION 1..1927: note = synthetic sequence for use in compositions and/or methods
MNPLEMFETVPVWRRQPVRVLSLFEDIKKELTSLGFLESGSDPGQLKHVVDVTDTVRKDVEEWGPFDLVYGATPPLGHTCDRPPSWYLFQFHRLLQYARPKPGSPRPFFWMFVDNLVLNKEDLDVASRFLEMEPVTIPDVHGGSLQNAVRVWSNIPAIRSRHWALVSEEELSLLAQNKQSSKLAAKWPTKLVKNCFLPLREYFKYFSTELTSSLGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKVATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 251 - protein, 1930 aa, synthetic construct
  REGION 1..1930: note = synthetic sequence for use in compositions and/or methods
MGSLEVFKTVPAWKREPIRVLSLFGDIRKELTSLGFLESGSGSEEGKLKYLDDVTDVVRRDVGKWGPFDLMYGSTQPRSHSCHNCPAWYMYQFHRILQYAQPNSKSQQPFFWMFADNLLLSDEDVRTANRFFEMQFVILQDVCDRVPQNAVRVWSNIPALRSRHMALTPEEEESLKAQVKAKAKLAVQGPPSLVKNCFLPLREYFKYFSENSLPPYPGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKVATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 252 - protein, 1927 aa, synthetic construct
  REGION 1..1927: note = synthetic sequence for use in compositions and/or methods
MSPLEMYQTVPVWKREPVRVLSLFGDIKRELTSLGFLEDGAGPGGLKYLDDVTDVVRRDVEEWGPFDLLYGATPPLGHTCYHPPGWYLFQFCRLRQYARPPPGSPRPFFWMFVDNLVLTQEDVAAATRFLEMEPVTIQDVCGRALQDATRVWSNIPAVRSKHSGPISEEELSLLAQDRQRARLPPRTPAQLVKNCFLPLREYFKYFSAELTSSLGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKVATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 253 - protein, 1926 aa, synthetic construct
  REGION 1..1926: note = synthetic sequence for use in compositions and/or methods
MSPLEMYKTVPVWKREPVRVLSLFGDIKKELTSLGFLETGSDPGRLKHLDDVTDVVRRDVREWGPFDLVYGSTPPLGHACDHPPGWYLFQFHRILQYSRPRLASQQPFFWMFVDNLVLREDDRTTATRFLETDPVTIPDACGRAIHNAVHVWSNIPAVKSRHSALVSEEELSLLAQDKQRAKAPTQRPANLVKNCFLPLREYFKYFTELTSSLGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKVATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 254 - protein, 1926 aa, synthetic construct
  REGION 1..1926: note = synthetic sequence for use in compositions and/or methods
MSPQEIYKTVPAWKREPVRVLSLFGDIRKELTSLGFLEPGSEAGRLRHLEDVTDIVRRDVEEWGPFDLVYGSTPALGHACDHSPGWYLFQFHRLLQYARPRAGSPQAFFWMFVDNLLLTGDEQAIAARFLETEPVILQDVRGSALQNAVRVWTNIPAVKSRHSASEEELLLLAQDGQRGTLPAQGPSALVKNCFLPLREYFKYFSQNALPLYKGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKVATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 255 - protein, 1930 aa, synthetic construct
  REGION 1..1930: note = synthetic sequence for use in compositions and/or methods
MNPVKMYKIVSAWKRQPVRVLNLFGKIDKELESLGFLESGSGSEEGRLKYLEDVTNVVRRDVERWGPFDLVYGSTQPLGYSCNRCPGWYMFQFHRILQYAQPPSGSQQPFFWLFMDNLLLTEDDQATATRFFQVEAVTLQDVRSRVLQNAVRVWSNIPGLKSKHSALTPKELQSLETQTRTRGKMAAQKVDLLVKTCLLPLREYFKYFSQNPLPLYKGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKVATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 256 - protein, 1928 aa, synthetic construct
  REGION 1..1928: note = synthetic sequence for use in compositions and/or methods
MQPLEIYETVPACRRKPLRVLSLFEHIEKELASLGFLETGSSPGRIRHLDDVTDVVRRDVEQWGPFDLVYGSTPPLGHASPRSPGWYLFQFHRMLQYTQPTASTQRPFFWMFVDNLLLTRDDLVTATRFLEVEPATLQDVRGRVLQGAMRVWSNIPAVNSRHTELAPEAETALLAQSCRRAKASGEGLARLLKSCFLPLREYFKYFPQSPLPLRKGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKVATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 257 - protein, 1925 aa, synthetic construct
  REGION 1..1925: note = synthetic sequence for use in compositions and/or methods
MSPLEMYKTVPVWKREPVRVLSLFGDIKAELASLGFLESGSGPGRLKHLDDVTNTVRKDVEQWGPFDLVYGATPPFGQACDRPPGWYLFQFHRVLQYARPGGPRPFFWMFVDNLVLTEDDRAVASRFLEADPVTIRDACGRALQDAVHVWSNIPAVRSRHSALLPHEELSLLARDRQRARHPTPGPARLVKNCFLPLREYFKYFSTELTSSVGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKVATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 258 - protein, 1928 aa, synthetic construct
  REGION 1..1928: note = synthetic sequence for use in compositions and/or methods
MSPVEIYKTVSAWKRQPVRVLSLFGNIDKELKSLGFLESGSGSEGGTLKYVEDVTNVVRREVEKWGPFDLVYGSTQPLGYSCDRCPGWYMFQFHRILQYARPRQDSQQPFFWIFVDNLLLTEDDQETTVRFLQTEAVTLQDVRGRVLQNAVRVWSNIPGLKSKHADLTPKEEQSLRTQVRTRSKLAAQKVDSLVKYCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKVATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 259 - protein, 1926 aa, synthetic construct
  REGION 1..1926: note = synthetic sequence for use in compositions and/or methods
MSPLEMFETLPVWRRQPVRVLALFGDIKKELTSLGFLGSGSDQGRLKHLDDVTDVVRKDVEEWGPFDLLYGATPAPGHACDHPPAWYLFQFHRLLQYARPSGSPRPFFWMFVDHLMLNKEDQDLVCRFLEMEQATIPDVRGGVLQSAVRVWSNIPAIRSRHWALPSEEELSVLTQNRQSSKLPAQRPTKLLKNCFLPLREYFKYFSTELTSSTGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKVATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 260 - protein, 1924 aa, synthetic construct
  REGION 1..1924: note = synthetic sequence for use in compositions and/or methods
MSPLEMYKTVPVWKREPVRVLSLFGDIKKELMSLGFLENGSEAGTRRHLDDVTNVVRREVEDWGPFDLVYGSTPPLGRAFDRPPGWYLFQFHRILQYARPRPGSQQPFFWMFVDNLVLSEDDRAVATRFLETDPVTVQDAHGRTVRNAVHVWSNIPAVRSRHSAVVSQEELSLLAQDRQPPAQSPAALVKNCFLPLREYFKYFSAELTSCLGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKVATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 261 - protein, 1927 aa, synthetic construct
  REGION 1..1927: note = synthetic sequence for use in compositions and/or methods
MNPLETYKTVPVWKREPVRVLSLFGDIRRELVSLGFLENGSAPGRLKHLDDVTDVVRRDVEGWGPFDLVYGSTPPIGHACDHPPVWYLFQFHRILQYARPRPGSRQPFFWMFVDNLLLSQDDQTAATRFLEADPVTIQDVCGRAVRNAVHVWSNIPAVRSRHAALASCEELSLLAQDRQRTKPPAQGPAQLVKNCFLPLREYFKYFSTELTSSLGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKVATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 262 - protein, 1925 aa, synthetic construct
  REGION 1..1925: note = synthetic sequence for use in compositions and/or methods
MRPLEMYKTMPEWKRKPIQVLSLFGDIEEELVKFGFLENSSGNGNLKHLDDVTDVLRKDVEEWGPFDLIYGSTPPIGQISEHPPVWYFLQYYRVLQYGKPKMDSEKPFFWMFVDSLVLTKDDREIASRFLETDPVTIYEVCDEMIKNAVLVWSNIPSMKSNNSALTSDWDLPLVAQDIQSLNDFSLWPASLVNKCFNPLKEYFKCFSKDHTSGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKVATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 263 - protein, 896 aa, synthetic construct
  REGION 1..896: note = synthetic sequence for use in compositions and/or methods
MARTKQTARKSTGGGASSGAGSSSGGSAAGSGSSGASGSSGSASSGSGSGGSGGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEKRTADGSEFESPKKKRKVGVPAAMAERPFQCRICMRNFSRSDHLSEHIRTHTGEKPFACDICGRKFAARSTRTNHTKIHTGSQKPFQCRICMRNFSRSDDLTRHIRTHTGEKPFACDICGRKFAQSSDLRRHTKIHTGSQKPFQCRICMRNFSQSGSLTRHIRTHTGEKPFACDICGRKFADRSHLARHTKIHLRQKDAARGSKRTADGSEFEPKKKRKVSGSETPGTSESATPESRTLVTFKDVFVDFTREEWKLLDTAQQIVYRNVMLENYKNLVSLGYQLTKPDVILRLEKGEEPATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 264 - protein, 819 aa, synthetic construct
  REGION 1..819: note = synthetic sequence for use in compositions and/or methods
MARTKQTARKSTGGGASSGAGSSSGGSAAGSGSSGASGSSGSASSGSGSGGSGGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEKRTADGSEFESPKKKRKVGGVPAAMAERPFQCRICMRNFSRSDHLSEHIRTHTGEKPFACDICGRKFAARSTRTNHTKIHTGSQKPFQCRICMRNFSRSDDLTRHIRTHTGEKPFACDICGRKFAQSSDLRRHTKIHTGSQKPFQCRICMRNFSQSGSLTRHIRTHTGEKPFACDICGRKFADRSHLARHTKIHLRQKDAARGSKRTADGSEFEPKKKRKVATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 265 - protein, 1979 aa, synthetic construct
  REGION 1..1979: note = synthetic sequence for use in compositions and/or methods
MARTKQTARKSTGGGASSGAGSSSGGSAAGSGSSGASGSSGSASSGSGSGGSGSPVEIYKTVSAWKRQPIRVLSLFGNIDKELKSLGFLESGSHSEGGTLKYVEDVTNVVRRDVEKWGPFDLLYGSTQPLGGSCDRCPGWYMFQFHRILQYARPRQESQPFFWIFMDNLLLTEDDQMTTVRFLQTEAVTLRDVRSRVLQNAVRVWSNIPGLKSKHEALSPKEEESLQGHVRTRSKLAAPKVDPLVKNCLLPLREYFKYFSQSSLPLGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKVATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 266 - protein, 2057 aa, synthetic construct
  REGION 1..2057: note = synthetic sequence for use in compositions and/or methods
MARTKQTARKSTGGGASSGAGSSSGGSAAGSGSSGASGSSGSASSGSGSGGSGSPVEIYKTVSAWKRQPIRVLSLFGNIDKELKSLGFLESGSHSEGGTLKYVEDVTNVVRRDVEKWGPFDLLYGSTQPLGGSCDRCPGWYMFQFHRILQYARPRQESQPFFWIFMDNLLLTEDDQMTTVRFLQTEAVTLRDVRSRVLQNAVRVWSNIPGLKSKHEALSPKEEESLQGHVRTRSKLAAPKVDPLVKNCLLPLREYFKYFSQSSLPLGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKVSGSETPGTSESATPESRTLVTFKDVFVDFTREEWKLLDTAQQIVYRNVMLENYKNLVSLGYQLTKPDVILRLEKGEEPATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 267 - protein, 895 aa, synthetic construct
  REGION 1..895: note = synthetic sequence for use in compositions and/or methods
MARTKQTARKSTGGGASSGAGSSSGGSAAGSGSSGASGSSGSASSGSGSGGSGSPVEIYKTVSAWKRQPIRVLSLFGNIDKELKSLGFLESGSHSEGGTLKYVEDVTNVVRRDVEKWGPFDLLYGSTQPLGGSCDRCPGWYMFQFHRILQYARPRQESQPFFWIFMDNLLLTEDDQMTTVRFLQTEAVTLRDVRSRVLQNAVRVWSNIPGLKSKHEALSPKEEESLQGHVRTRSKLAAPKVDPLVKNCLLPLREYFKYFSQSSLPLGGPSSGAPPPSGGSPAGSPTSTEEGTSESATPESGPGTSTEPSEGSAPGSPAGSPTSTEEGTSTEPSEGSAPGTSTEPSEKRTADGSEFESPKKKRKVGVPAAMAERPFQCRICMRNFSRSDHLSEHIRTHTGEKPFACDICGRKFAARSTRTNHTKIHTGSQKPFQCRICMRNFSRSDDLTRHIRTHTGEKPFACDICGRKFAQSSDLRRHTKIHTGSQKPFQCRICMRNFSQSGSLTRHIRTHTGEKPFACDICGRKFADRSHLARHTKIHLRQKDAARGSKRTADGSEFEPKKKRKVSGSETPGTSESATPESRTLVTFKDVFVDFTREEWKLLDTAQQIVYRNVMLENYKNLVSLGYQLTKPDVILRLEKGEEPATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 268 - protein, 914 aa, synthetic construct
  REGION 1..914: note = synthetic sequence for use in compositions and/or methods
MATNFSLLKQAGDVEENPGPARTKQTARKSTGGGASSGAGSSSGGSAAGSGSSGASGSSGSASSGSGSGGSGSPVEIYKTVSAWKRQPIRVLSLFGNIDKELKSLGFLESGSHSEGGTLKYVEDVTNVVRRDVEKWGPFDLLYGSTQPLGGSCDRCPGWYMFQFHRILQYARPRQESQPFFWIFMDNLLLTEDDQMTTVRFLQTEAVTLRDVRSRVLQNAVRVWSNIPGLKSKHEALSPKEEESLQGHVRTRSKLAAPKVDPLVKNCLLPLREYFKYFSQSSLPLGGPSSGAPPPSGGSPAGSPTSTEEGTSESATPESGPGTSTEPSEGSAPGSPAGSPTSTEEGTSTEPSEGSAPGTSTEPSEKRTADGSEFESPKKKRKVGVPAAMAERPFQCRICMRNFSRSDHLSEHIRTHTGEKPFACDICGRKFAARSTRTNHTKIHTGSQKPFQCRICMRNFSRSDDLTRHIRTHTGEKPFACDICGRKFAQSSDLRRHTKIHTGSQKPFQCRICMRNFSQSGSLTRHIRTHTGEKPFACDICGRKFADRSHLARHTKIHLRQKDAARGSKRTADGSEFEPKKKRKVSGSETPGTSESATPESRTLVTFKDVFVDFTREEWKLLDTAQQIVYRNVMLENYKNLVSLGYQLTKPDVILRLEKGEEPATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 269 - protein, 916 aa, synthetic construct
  REGION 1..916: note = synthetic sequence for use in compositions and/or methods
MGSGEGRGSLLTCGDVEENPGPARTKQTARKSTGGGASSGAGSSSGGSAAGSGSSGASGSSGSASSGSGSGGSGSPVEIYKTVSAWKRQPIRVLSLFGNIDKELKSLGFLESGSHSEGGTLKYVEDVTNVVRRDVEKWGPFDLLYGSTQPLGGSCDRCPGWYMFQFHRILQYARPRQESQPFFWIFMDNLLLTEDDQMTTVRFLQTEAVTLRDVRSRVLQNAVRVWSNIPGLKSKHEALSPKEEESLQGHVRTRSKLAAPKVDPLVKNCLLPLREYFKYFSQSSLPLGGPSSGAPPPSGGSPAGSPTSTEEGTSESATPESGPGTSTEPSEGSAPGSPAGSPTSTEEGTSTEPSEGSAPGTSTEPSEKRTADGSEFESPKKKRKVGVPAAMAERPFQCRICMRNFSRSDHLSEHIRTHTGEKPFACDICGRKFAARSTRTNHTKIHTGSQKPFQCRICMRNFSRSDDLTRHIRTHTGEKPFACDICGRKFAQSSDLRRHTKIHTGSQKPFQCRICMRNFSQSGSLTRHIRTHTGEKPFACDICGRKFADRSHLARHTKIHLRQKDAARGSKRTADGSEFEPKKKRKVSGSETPGTSESATPESRTLVTFKDVFVDFTREEWKLLDTAQQIVYRNVMLENYKNLVSLGYQLTKPDVILRLEKGEEPATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 270 - protein, 895 aa, synthetic construct
  REGION 1..895: note = synthetic sequence for use in compositions and/or methods
MARTAQTARKSTGGGASSGAGSSSGGSAAGSGSSGASGSSGSASSGSGSGGSGSPVEIYKTVSAWKRQPIRVLSLFGNIDKELKSLGFLESGSHSEGGTLKYVEDVTNVVRRDVEKWGPFDLLYGSTQPLGGSCDRCPGWYMFQFHRILQYARPRQESQPFFWIFMDNLLLTEDDQMTTVRFLQTEAVTLRDVRSRVLQNAVRVWSNIPGLKSKHEALSPKEEESLQGHVRTRSKLAAPKVDPLVKNCLLPLREYFKYFSQSSLPLGGPSSGAPPPSGGSPAGSPTSTEEGTSESATPESGPGTSTEPSEGSAPGSPAGSPTSTEEGTSTEPSEGSAPGTSTEPSEKRTADGSEFESPKKKRKVGVPAAMAERPFQCRICMRNFSRSDHLSEHIRTHTGEKPFACDICGRKFAARSTRTNHTKIHTGSQKPFQCRICMRNFSRSDDLTRHIRTHTGEKPFACDICGRKFAQSSDLRRHTKIHTGSQKPFQCRICMRNFSQSGSLTRHIRTHTGEKPFACDICGRKFADRSHLARHTKIHLRQKDAARGSKRTADGSEFEPKKKRKVSGSETPGTSESATPESRTLVTFKDVFVDFTREEWKLLDTAQQIVYRNVMLENYKNLVSLGYQLTKPDVILRLEKGEEPATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 271 - protein, 843 aa, synthetic construct
  REGION 1..843: note = synthetic sequence for use in compositions and/or methods
MSPVEIYKTVSAWKRQPIRVLSLFGNIDKELKSLGFLESGSHSEGGTLKYVEDVTNVVRRDVEKWGPFDLLYGSTQPLGGSCDRCPGWYMFQFHRILQYARPRQESQPFFWIFMDNLLLTEDDQMTTVRFLQTEAVTLRDVRSRVLQNAVRVWSNIPGLKSKHEALSPKEEESLQGHVRTRSKLAAPKVDPLVKNCLLPLREYFKYFSQSSLPLGGPSSGAPPPSGGSPAGSPTSTEEGTSESATPESGPGTSTEPSEGSAPGSPAGSPTSTEEGTSTEPSEGSAPGTSTEPSEKRTADGSEFESPKKKRKVGVPAAMAERPFQCRICMRNFSRSDHLSEHIRTHTGEKPFACDICGRKFAARSTRTNHTKIHTGSQKPFQCRICMRNFSRSDDLTRHIRTHTGEKPFACDICGRKFAQSSDLRRHTKIHTGSQKPFQCRICMRNFSQSGSLTRHIRTHTGEKPFACDICGRKFADRSHLARHTKIHLRQKDAARGSKRTADGSEFEPKKKRKVSGSETPGTSESATPESRTLVTFKDVFVDFTREEWKLLDTAQQIVYRNVMLENYKNLVSLGYQLTKPDVILRLEKGEEPATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 272 - protein, 908 aa, synthetic construct
  REGION 1..908: note = synthetic sequence for use in compositions and/or methods
MARTKQTARKSTGGGASSGAGSSSGGSAAGSGSSGASGSSGSASSGSGSGGSGSPVEIYKTVSAWKRQPIRVLSLFGNIDKELKSLGFLESGSHSEGGTLKYVEDVTNVVRRDVEKWGPFDLLYGSTQPLGGSCDRCPGWYMFQFHRILQYARPRQESQPFFWIFMDNLLLTEDDQMTTVRFLQTEAVTLRDVRSRVLQNAVRVWSNIPGLKSKHEALSPKEEESLQGHVRTRSKLAAPKVDPLVKNCLLPLREYFKYFSQSSLPLGGPSSGAPPPSGGSPAGSPTSTEEGTSESATPESGPGTSTEPSEGSAPGSPAGSPTSTEEGTSTEPSEGSAPGTSTEPSEKRTADGSEFESPKKKRKVGGVPAAMAERPFQCRICMNFSYKCCLSDHIRTHTGEKPFACDICGRKFARSANLTRHTKIHTGSQKPFQCRICMNFSRSDHLSAHIRTHTGEKPFACDICGRKFADRSALARHTKIHTHPRAPIPKPFQCRICMNFSIKHDLHRHIRTHTGEKPFACDICGRKFARSANLTRHTKIHLRQKDAARGSGGDAKSLTAWSKRTADGSEFEPKKKRKVSGSETPGTSESATPESRTLVTFKDVFVDFTREEWKLLDTAQQIVYRNVMLENYKNLVSLGYQLTKPDVILRLEKGEEPATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 273 - protein, 906 aa, synthetic construct
  REGION 1..906: note = synthetic sequence for use in compositions and/or methods
MARTKQTARKSTGGGASSGAGSSSGGSAAGSGSSGASGSSGSASSGSGSGGSGSPVEIYKTVSAWKRQPIRVLSLFGNIDKELKSLGFLESGSHSEGGTLKYVEDVTNVVRRDVEKWGPFDLLYGSTQPLGGSCDRCPGWYMFQFHRILQYARPRQESQPFFWIFMDNLLLTEDDQMTTVRFLQTEAVTLRDVRSRVLQNAVRVWSNIPGLKSKHEALSPKEEESLQGHVRTRSKLAAPKVDPLVKNCLLPLREYFKYFSQSSLPLGGPSSGAPPPSGGSPAGSPTSTEEGTSESATPESGPGTSTEPSEGSAPGSPAGSPTSTEEGTSTEPSEGSAPGTSTEPSEKRTADGSEFESPKKKRKVGGVPAAMAERPFQCRICMQNFSYPKDLARHIRTHTGEKPFACDICGRKFATSGNLTRHTKIHTGSQKPFQCRICMQNFSTSGSLSRHIRTHTGEKPFACDICGRKFAQSADRTKHTKIHTGSQKPFQCRICMNFSQSGDLTRHIRTHTGEKPFACDICGRKFAYRWLRNNHTKIHLRQKDAARGSGGDAKSLTAWSKRTADGSEFEPKKKRKVSGSETPGTSESATPESRTLVTFKDVFVDFTREEWKLLDTAQQIVYRNVMLENYKNLVSLGYQLTKPDVILRLEKGEEPATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 274 - protein, 908 aa, synthetic construct
  REGION 1..908: note = synthetic sequence for use in compositions and/or methods
MARTKQTARKSTGGGASSGAGSSSGGSAAGSGSSGASGSSGSASSGSGSGGSGSPVEIYKTVSAWKRQPIRVLSLFGNIDKELKSLGFLESGSHSEGGTLKYVEDVTNVVRRDVEKWGPFDLLYGSTQPLGGSCDRCPGWYMFQFHRILQYARPRQESQPFFWIFMDNLLLTEDDQMTTVRFLQTEAVTLRDVRSRVLQNAVRVWSNIPGLKSKHEALSPKEEESLQGHVRTRSKLAAPKVDPLVKNCLLPLREYFKYFSQSSLPLGGPSSGAPPPSGGSPAGSPTSTEEGTSESATPESGPGTSTEPSEGSAPGSPAGSPTSTEEGTSTEPSEGSAPGTSTEPSEKRTADGSEFESPKKKRKVGGVPAAMAERPFQCRICMNFSRSADLTRHIRTHTGEKPFACDICGRKFAQSGDLTRHTKIHTHPRAPIPKPFQCRICMNFSRSDHLSRHIRTHTGEKPFACDICGRKFADRSNRKTHTKIHTGSQKPFQCRICMNFSTSGSLSRHIRTHTGEKPFACDICGRKFAQNANLMKHTKIHLRQKDAARGSGGDAKSLTAWSKRTADGSEFEPKKKRKVSGSETPGTSESATPESRTLVTFKDVFVDFTREEWKLLDTAQQIVYRNVMLENYKNLVSLGYQLTKPDVILRLEKGEEPATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 275 - protein, 907 aa, synthetic construct
  REGION 1..907: note = synthetic sequence for use in compositions and/or methods
MARTKQTARKSTGGGASSGAGSSSGGSAAGSGSSGASGSSGSASSGSGSGGSGSPVEIYKTVSAWKRQPIRVLSLFGNIDKELKSLGFLESGSHSEGGTLKYVEDVTNVVRRDVEKWGPFDLLYGSTQPLGGSCDRCPGWYMFQFHRILQYARPRQESQPFFWIFMDNLLLTEDDQMTTVRFLQTEAVTLRDVRSRVLQNAVRVWSNIPGLKSKHEALSPKEEESLQGHVRTRSKLAAPKVDPLVKNCLLPLREYFKYFSQSSLPLGGPSSGAPPPSGGSPAGSPTSTEEGTSESATPESGPGTSTEPSEGSAPGSPAGSPTSTEEGTSTEPSEGSAPGTSTEPSEKRTADGSEFESPKKKRKVGGVPAAMAERPFQCRICMRNFSTSGHLSRHIRTHTGEKPFACDICGRKFAQSGHLSRHTKIHTGSQKPFQCRICMRNFSDRSHLTRHIRTHTGEKPFACDICGRKFAQSSDLRRHTKIHTGSQKPFQCRICMRNFSDRSYRNTHIRTHTGEKPFACDICGRKFARRSDLKRHTKIHLRQKDAARGSGGDAKSLTAWSKRTADGSEFEPKKKRKVSGSETPGTSESATPESRTLVTFKDVFVDFTREEWKLLDTAQQIVYRNVMLENYKNLVSLGYQLTKPDVILRLEKGEEPATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 276 - protein, 906 aa, synthetic construct
  REGION 1..906: note = synthetic sequence for use in compositions and/or methods
MARTKQTARKSTGGGASSGAGSSSGGSAAGSGSSGASGSSGSASSGSGSGGSGSPVEIYKTVSAWKRQPIRVLSLFGNIDKELKSLGFLESGSHSEGGTLKYVEDVTNVVRRDVEKWGPFDLLYGSTQPLGGSCDRCPGWYMFQFHRILQYARPRQESQPFFWIFMDNLLLTEDDQMTTVRFLQTEAVTLRDVRSRVLQNAVRVWSNIPGLKSKHEALSPKEEESLQGHVRTRSKLAAPKVDPLVKNCLLPLREYFKYFSQSSLPLGGPSSGAPPPSGGSPAGSPTSTEEGTSESATPESGPGTSTEPSEGSAPGSPAGSPTSTEEGTSTEPSEGSAPGTSTEPSEKRTADGSEFESPKKKRKVGGVPAAMAERPFQCRICMQNFSDRSNLSRHIRTHTGEKPFACDICGRKFALRQDLKRHTKIHTGSQKPFQCRICMQNFSDRSALSRHIRTHTGEKPFACDICGRKFAQSGDLTRHTKIHTGSQKPFQCRICMNFSRSANLARHIRTHTGEKPFACDICGRKFADSSDRKKHTKIHLRQKDAARGSGGDAKSLTAWSKRTADGSEFEPKKKRKVSGSETPGTSESATPESRTLVTFKDVFVDFTREEWKLLDTAQQIVYRNVMLENYKNLVSLGYQLTKPDVILRLEKGEEPATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 277 - protein, 908 aa, synthetic construct
  REGION 1..908: note = synthetic sequence for use in compositions and/or methods
MARTKQTARKSTGGGASSGAGSSSGGSAAGSGSSGASGSSGSASSGSGSGGSGSPVEIYKTVSAWKRQPIRVLSLFGNIDKELKSLGFLESGSHSEGGTLKYVEDVTNVVRRDVEKWGPFDLLYGSTQPLGGSCDRCPGWYMFQFHRILQYARPRQESQPFFWIFMDNLLLTEDDQMTTVRFLQTEAVTLRDVRSRVLQNAVRVWSNIPGLKSKHEALSPKEEESLQGHVRTRSKLAAPKVDPLVKNCLLPLREYFKYFSQSSLPLGGPSSGAPPPSGGSPAGSPTSTEEGTSESATPESGPGTSTEPSEGSAPGSPAGSPTSTEEGTSTEPSEGSAPGTSTEPSEKRTADGSEFESPKKKRKVGGVPAAMAERPFQCRICMNFSQSGHLARHIRTHTGEKPFACDICGRKFAQLTHLNSHTKIHTHPRAPIPKPFQCRICMNFSRSDNLARHIRTHTGEKPFACDICGRKFAMRHHLDDHTKIHTGSQKPFQCRICMNFSLRHHLTRHIRTHTGEKPFACDICGRKFADRSYRNTHTKIHLRQKDAARGSGGDAKSLTAWSKRTADGSEFEPKKKRKVSGSETPGTSESATPESRTLVTFKDVFVDFTREEWKLLDTAQQIVYRNVMLENYKNLVSLGYQLTKPDVILRLEKGEEPATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 278 - protein, 911 aa, synthetic construct
  REGION 1..911: note = synthetic sequence for use in compositions and/or methods
MARTKQTARKSTGGGASSGAGSSSGGSAAGSGSSGASGSSGSASSGSGSGGSGSPVEIYKTVSAWKRQPIRVLSLFGNIDKELKSLGFLESGSHSEGGTLKYVEDVTNVVRRDVEKWGPFDLLYGSTQPLGGSCDRCPGWYMFQFHRILQYARPRQESQPFFWIFMDNLLLTEDDQMTTVRFLQTEAVTLRDVRSRVLQNAVRVWSNIPGLKSKHEALSPKEEESLQGHVRTRSKLAAPKVDPLVKNCLLPLREYFKYFSQSSLPLGGPSSGAPPPSGGSPAGSPTSTEEGTSESATPESGPGTSTEPSEGSAPGSPAGSPTSTEEGTSTEPSEGSAPGTSTEPSEKRTADGSEFESPKKKRKVGGVPAAMAERPFQCRICMRNFSRSDDLTRHIRTHTGEKPFACDICGRKFAQSSDLRRHTKIHTGSQKPFQCRICMRNFSDRSHLTRHIRTHTGEKPFACDICGRKFARLDWLPMHTKIHTHPRAPIPKPFQCRICMRNFSTSGNLTRHIRTHTGEKPFACDICGRKFADLTTLRKHTKIHLRQKDAARGSGGDAKSLTAWSKRTADGSEFEPKKKRKVSGSETPGTSESATPESRTLVTFKDVFVDFTREEWKLLDTAQQIVYRNVMLENYKNLVSLGYQLTKPDVILRLEKGEEPATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 279 - protein, 911 aa, synthetic construct
  REGION 1..911: note = synthetic sequence for use in compositions and/or methods
MARTKQTARKSTGGGASSGAGSSSGGSAAGSGSSGASGSSGSASSGSGSGGSGSPVEIYKTVSAWKRQPIRVLSLFGNIDKELKSLGFLESGSHSEGGTLKYVEDVTNVVRRDVEKWGPFDLLYGSTQPLGGSCDRCPGWYMFQFHRILQYARPRQESQPFFWIFMDNLLLTEDDQMTTVRFLQTEAVTLRDVRSRVLQNAVRVWSNIPGLKSKHEALSPKEEESLQGHVRTRSKLAAPKVDPLVKNCLLPLREYFKYFSQSSLPLGGPSSGAPPPSGGSPAGSPTSTEEGTSESATPESGPGTSTEPSEGSAPGSPAGSPTSTEEGTSTEPSEGSAPGTSTEPSEKRTADGSEFESPKKKRKVGGVPAAMAERPFQCRICMRNFSTSGNLTRHIRTHTGEKPFACDICGRKFALSQDLNRHTKIHTHPRAPIPKPFQCRICMRNFSDRSALSRHIRTHTGEKPFACDICGRKFARNDDRKKHTKIHTGSQKPFQCRICMRNFSQSGNLARHIRTHTGEKPFACDICGRKFAQRIDLTRHTKIHLRQKDAARGSGGDAKSLTAWSKRTADGSEFEPKKKRKVSGSETPGTSESATPESRTLVTFKDVFVDFTREEWKLLDTAQQIVYRNVMLENYKNLVSLGYQLTKPDVILRLEKGEEPATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 280 - protein, 907 aa, synthetic construct
  REGION 1..907: note = synthetic sequence for use in compositions and/or methods
MARTKQTARKSTGGGASSGAGSSSGGSAAGSGSSGASGSSGSASSGSGSGGSGSPVEIYKTVSAWKRQPIRVLSLFGNIDKELKSLGFLESGSHSEGGTLKYVEDVTNVVRRDVEKWGPFDLLYGSTQPLGGSCDRCPGWYMFQFHRILQYARPRQESQPFFWIFMDNLLLTEDDQMTTVRFLQTEAVTLRDVRSRVLQNAVRVWSNIPGLKSKHEALSPKEEESLQGHVRTRSKLAAPKVDPLVKNCLLPLREYFKYFSQSSLPLGGPSSGAPPPSGGSPAGSPTSTEEGTSESATPESGPGTSTEPSEGSAPGSPAGSPTSTEEGTSTEPSEGSAPGTSTEPSEKRTADGSEFESPKKKRKVGGVPAAMAERPFQCRICMRNFSRSDHLSEHIRTHTGEKPFACDICGRKFAYSWRLSQHTKIHTGSQKPFQCRICMRNFSLRHHLTRHIRTHTGEKPFACDICGRKFAQSGTRKTHTKIHTGSQKPFQCRICMRNFSRSDVLSKHIRTHTGEKPFACDICGRKFARSDDRIKHTKIHLRQKDAARGSGGDAKSLTAWSKRTADGSEFEPKKKRKVSGSETPGTSESATPESRTLVTFKDVFVDFTREEWKLLDTAQQIVYRNVMLENYKNLVSLGYQLTKPDVILRLEKGEEPATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 281 - protein, 1981 aa, synthetic construct
  REGION 1..1981: note = synthetic sequence for use in compositions and/or methods
MARTKQTARKSTGGGASSGAGSSSGGSAAGSGSSGASGSSGSASSGSGSGGSGGSSPVEIYKTVSAWKRQPIRVLSLFGNIDKELKSLGFLESGSHSEGGTLKYVEDVTNVVRRDVEKWGPFDLLYGSTQPLGGSCDRCPGWYMFQFHRILQYARPRQESQPFFWIFMDNLLLTEDDQMTTVRFLQTEAVTLRDVRSRVLQNAVRVWSNIPGLKSKHEALSPKEEESLQGHVRTRSKLAAPKVDPLVKNCLLPLREYFKYFSQSSLPLGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKVATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 282 - protein, 1983 aa, synthetic construct
  REGION 1..1983: note = synthetic sequence for use in compositions and/or methods
MARTKQTARKSTGGGASSGAGSSSGGSAAGSGSSGASGSSGSASSGSGSGGSGGSSGSPVEIYKTVSAWKRQPIRVLSLFGNIDKELKSLGFLESGSHSEGGTLKYVEDVTNVVRRDVEKWGPFDLLYGSTQPLGGSCDRCPGWYMFQFHRILQYARPRQESQPFFWIFMDNLLLTEDDQMTTVRFLQTEAVTLRDVRSRVLQNAVRVWSNIPGLKSKHEALSPKEEESLQGHVRTRSKLAAPKVDPLVKNCLLPLREYFKYFSQSSLPLGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKVATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 283 - protein, 1985 aa, synthetic construct
  REGION 1..1985: note = synthetic sequence for use in compositions and/or methods
MARTKQTARKSTGGGASSGAGSSSGGSAAGSGSSGASGSSGSASSGSGSGGSGGSSGGSSPVEIYKTVSAWKRQPIRVLSLFGNIDKELKSLGFLESGSHSEGGTLKYVEDVTNVVRRDVEKWGPFDLLYGSTQPLGGSCDRCPGWYMFQFHRILQYARPRQESQPFFWIFMDNLLLTEDDQMTTVRFLQTEAVTLRDVRSRVLQNAVRVWSNIPGLKSKHEALSPKEEESLQGHVRTRSKLAAPKVDPLVKNCLLPLREYFKYFSQSSLPLGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKVATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 284 - protein, 1977 aa, synthetic construct
  REGION 1..1977: note = synthetic sequence for use in compositions and/or methods
MARTKQTARKSTGGGASSGAGSSSGGSAAGSGSSGASGSSGSASSGSGSGGSPVEIYKTVSAWKRQPIRVLSLFGNIDKELKSLGFLESGSHSEGGTLKYVEDVTNVVRRDVEKWGPFDLLYGSTQPLGGSCDRCPGWYMFQFHRILQYARPRQESQPFFWIFMDNLLLTEDDQMTTVRFLQTEAVTLRDVRSRVLQNAVRVWSNIPGLKSKHEALSPKEEESLQGHVRTRSKLAAPKVDPLVKNCLLPLREYFKYFSQSSLPLGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKVATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 285 - protein, 1975 aa, synthetic construct
  REGION 1..1975: note = synthetic sequence for use in compositions and/or methods
MARTKQTARKSTGGGASSGAGSSSGGSAAGSGSSGASGSSGSASSGSGSSPVEIYKTVSAWKRQPIRVLSLFGNIDKELKSLGFLESGSHSEGGTLKYVEDVTNVVRRDVEKWGPFDLLYGSTQPLGGSCDRCPGWYMFQFHRILQYARPRQESQPFFWIFMDNLLLTEDDQMTTVRFLQTEAVTLRDVRSRVLQNAVRVWSNIPGLKSKHEALSPKEEESLQGHVRTRSKLAAPKVDPLVKNCLLPLREYFKYFSQSSLPLGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKVATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 286 - protein, 1997 aa, synthetic construct
  REGION 1..1997: note = synthetic sequence for use in compositions and/or methods
MARTKQTARKSTGGKAPRKQLATKAARKSAPGGASSGAGSSSGGSAAGSGSGGASSGAASSSAGSAAGSGSSPVEIYKTVSAWKRQPIRVLSLFGNIDKELKSLGFLESGSHSEGGTLKYVEDVTNVVRRDVEKWGPFDLLYGSTQPLGGSCDRCPGWYMFQFHRILQYARPRQESQPFFWIFMDNLLLTEDDQMTTVRFLQTEAVTLRDVRSRVLQNAVRVWSNIPGLKSKHEALSPKEEESLQGHVRTRSKLAAPKVDPLVKNCLLPLREYFKYFSQSSLPLGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKVATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 287 - protein, 1989 aa, synthetic construct
  REGION 1..1989: note = synthetic sequence for use in compositions and/or methods
MARTKQTARKSTGGKAPRKQLATKAARKSAPGGASSGAGSSSGGSAAGSGSGGASSGAASSSASPVEIYKTVSAWKRQPIRVLSLFGNIDKELKSLGFLESGSHSEGGTLKYVEDVTNVVRRDVEKWGPFDLLYGSTQPLGGSCDRCPGWYMFQFHRILQYARPRQESQPFFWIFMDNLLLTEDDQMTTVRFLQTEAVTLRDVRSRVLQNAVRVWSNIPGLKSKHEALSPKEEESLQGHVRTRSKLAAPKVDPLVKNCLLPLREYFKYFSQSSLPLGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKVATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 288 - protein, 1983 aa, synthetic construct
  REGION 1..1983: note = synthetic sequence for use in compositions and/or methods
MARTKQTARKSTGGKAPRKQLATKAARKSAPGGASSGAGSSSGGSAAGSGSGGASSGSPVEIYKTVSAWKRQPIRVLSLFGNIDKELKSLGFLESGSHSEGGTLKYVEDVTNVVRRDVEKWGPFDLLYGSTQPLGGSCDRCPGWYMFQFHRILQYARPRQESQPFFWIFMDNLLLTEDDQMTTVRFLQTEAVTLRDVRSRVLQNAVRVWSNIPGLKSKHEALSPKEEESLQGHVRTRSKLAAPKVDPLVKNCLLPLREYFKYFSQSSLPLGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKVATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 289 - protein, 1977 aa, synthetic construct
  REGION 1..1977: note = synthetic sequence for use in compositions and/or methods
MARTKQTARKSTGGKAPRKQLATKAARKSAPGGASSGAGSSSGGSAAGSGSSPVEIYKTVSAWKRQPIRVLSLFGNIDKELKSLGFLESGSHSEGGTLKYVEDVTNVVRRDVEKWGPFDLLYGSTQPLGGSCDRCPGWYMFQFHRILQYARPRQESQPFFWIFMDNLLLTEDDQMTTVRFLQTEAVTLRDVRSRVLQNAVRVWSNIPGLKSKHEALSPKEEESLQGHVRTRSKLAAPKVDPLVKNCLLPLREYFKYFSQSSLPLGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKVATNFSLLKQAGDVEENPGPSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 290 - DNA, 7011 bp, synthetic construct
  misc_feature 1..7011: note = synthetic sequence for use in compositions and/or methods
  source 1..7011: mol_type = other DNA
atgaaccacgaccaggagtttgatcctcctaaggtgtatcctcctgtgcccgcagaaaagcgaaaacctatcagagtgctgtcactgttcgacggcatcgccaccggcctgctggtgctgaaggacctcggcatccaggtggaccggtacatcgctagcgaggtgtgcgaggacagcatcaccgtgggcatggtgaggcaccagggcaagatcatgtacgtgggagatgtgagaagcgtgacccagaaacacatccaggagtggggccccttcgacctggtgatcggcggcagcccctgcaacgacctgagcatcgtgaatccagccagaaagggcctgtacgagggcactggcagactgtttttcgagttctacagactgctgcacgatgccagacctaaagagggagatgacaggcctttcttctggctgttcgagaacgtggtggccatgggcgtgagtgataagagagatatcagcagattcctggaatctaaccccgtcatgatcgacgccaaggaggtgtccgccgcccaccgggccagatacttctggggaaatctgcctggcatgaacagacctcttgcttctaccgtgaacgacaagctggaactgcaggagtgcctggaacacggccggatcgccaaattctccaaggtgagaacaatcaccacaagaagcaacagcattaagcagggaaaggaccaacatttccccgttttcatgaacgagaaggaggatatcctgtggtgcaccgagatggaaagagtgtttggctttccagtgcactacaccgacgtttctaatatgagcagactggccagacaaagactgctgggcagaagctggagcgtgcctgtgatccggcacctgtttgcccctctgaaggaatatttcgcctgtgtgtcttctggcaactctaatgctaacagcagaggacctagcttcagcagcggactggttccactgagcctgagaggcagccatatgggacctatggaaatctacaagaccgtgtccgcttggaagcgccagcccgtgcgggtgctcagcctgtttagaaacatcgacaaggtgctgaaaagcctgggattcctggaatccggatctggcagcggcggcggcaccctgaagtacgtggaagatgtgacaaacgtggttaggcgggacgtcgagaagtggggcccttttgacctggtgtacggctccacccagcccctgggctccagctgtgaccggtgccccggctggtacatgttccagttccacagaatactgcagtacgccctgcctagacaggagagccagcggcctttcttctggatcttcatggacaacctgcttctgaccgaagatgatcaggagacaacaaccagattcctgcagaccgaagccgtgaccctgcaagacgtgcggggccgggactaccagaacgctatgagagtgtggtccaacatccccggcctgaagagcaagcacgcccccctgacccctaaagaagaagagtacctgcaggcccaggtccggtcccggagcaagctggacgcccctaaggtggacctgctggtgaagaactgcctgctgcctctgcgggaatacttcaagtacttctctcagaacagcctgcccctgggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtgtccggctctgaaacccctggaacctccgagagcgccacacctgaaagcagaaccctggtgaccttcaaggacgtgttcgtggacttcacccgcgaggaatggaagctcctggacaccgcccagcaaatcgtgtaccggaacgtgatgctggagaattacaagaacctggtgtctctgggctaccagctgacgaagcctgacgtcatcctgagactggaaaagggagaggagcctgccacaaatttcagcctgctgaagcaggccggcgacgtggaagagaatcctggccccagcgagctgatcaaagagaacatgcacatgaagctgtacatggaaggcaccgtggacaaccatcacttcaagtgcaccagcgagggcgagggcaagccctacgagggcacacagaccatgagaatcaaggtggtggaaggaggcccactgcccttcgccttcgacatcctggccaccagctttctgtacggctcaaagaccttcatcaaccacacccagggcatccctgatttcttcaagcagagcttccctgagggatttacctgggagagagtgacaacttatgaagatggcggagtgctgaccgccacacaagataccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 291 - DNA, 5142 bp, synthetic construct
  misc_feature 1..5142: note = synthetic sequence for use in compositions and/or methods
  source 1..5142: mol_type = other DNA
atgcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtgtccggctctgaaacccctggaacctccgagagcgccacacctgaaagcagaaccctggtgaccttcaaggacgtgttcgtggacttcacccgcgaggaatggaagctcctggacaccgcccagcaaatcgtgtaccggaacgtgatgctggagaattacaagaacctggtgtctctgggctaccagctgacgaagcctgacgtcatcctgagactggaaaagggagaggagcctgccacaaatttcagcctgctgaagcaggccggcgacgtggaagagaatcctggccccagcgagctgatcaaagagaacatgcacatgaagctgtacatggaaggcaccgtggacaaccatcacttcaagtgcaccagcgagggcgagggcaagccctacgagggcacacagaccatgagaatcaaggtggtggaaggaggcccactgcccttcgccttcgacatcctggccaccagctttctgtacggctcaaagaccttcatcaaccacacccagggcatccctgatttcttcaagcagagcttccctgagggatttacctgggagagagtgacaacttatgaagatggcggagtgctgaccgccacacaagataccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 292 - DNA, 5790 bp, synthetic construct
  misc_feature 1..5790: note = synthetic sequence for use in compositions and/or methods
  source 1..5790: mol_type = other DNA
atgggacctatggaaatctacaagaccgtgtccgcttggaagcgccagcccgtgcgggtgctcagcctgtttagaaacatcgacaaggtgctgaaaagcctgggattcctggaatccggatctggcagcggcggcggcaccctgaagtacgtggaagatgtgacaaacgtggttaggcgggacgtcgagaagtggggcccttttgacctggtgtacggctccacccagcccctgggctccagctgtgaccggtgccccggctggtacatgttccagttccacagaatactgcagtacgccctgcctagacaggagagccagcggcctttcttctggatcttcatggacaacctgcttctgaccgaagatgatcaggagacaacaaccagattcctgcagaccgaagccgtgaccctgcaagacgtgcggggccgggactaccagaacgctatgagagtgtggtccaacatccccggcctgaagagcaagcacgcccccctgacccctaaagaagaagagtacctgcaggcccaggtccggtcccggagcaagctggacgcccctaaggtggacctgctggtgaagaactgcctgctgcctctgcgggaatacttcaagtacttctctcagaacagcctgcccctgggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtggccacaaatttcagcctgctgaagcaggccggcgacgtggaagagaatcctggccccagcgagctgatcaaagagaacatgcacatgaagctgtacatggaaggcaccgtggacaaccatcacttcaagtgcaccagcgagggcgagggcaagccctacgagggcacacagaccatgagaatcaaggtggtggaaggaggcccactgcccttcgccttcgacatcctggccaccagctttctgtacggctcaaagaccttcatcaaccacacccagggcatccctgatttcttcaagcagagcttccctgagggatttacctgggagagagtgacaacttatgaagatggcggagtgctgaccgccacacaagataccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 293 - DNA, 3561 bp, synthetic construct
  misc_feature 1..3561: note = synthetic sequence for use in compositions and/or methods
  source 1..3561: mol_type = other DNA
atgaaccacgaccaggagtttgatcctcctaaggtgtatcctcctgtgcccgcagaaaagcgaaaacctatcagagtgctgtcactgttcgacggcatcgccaccggcctgctggtgctgaaggacctcggcatccaggtggaccggtacatcgctagcgaggtgtgcgaggacagcatcaccgtgggcatggtgaggcaccagggcaagatcatgtacgtgggagatgtgagaagcgtgacccagaaacacatccaggagtggggccccttcgacctggtgatcggcggcagcccctgcaacgacctgagcatcgtgaatccagccagaaagggcctgtacgagggcactggcagactgtttttcgagttctacagactgctgcacgatgccagacctaaagagggagatgacaggcctttcttctggctgttcgagaacgtggtggccatgggcgtgagtgataagagagatatcagcagattcctggaatctaaccccgtcatgatcgacgccaaggaggtgtccgccgcccaccgggccagatacttctggggaaatctgcctggcatgaacagacctcttgcttctaccgtgaacgacaagctggaactgcaggagtgcctggaacacggccggatcgccaaattctccaaggtgagaacaatcaccacaagaagcaacagcattaagcagggaaaggaccaacatttccccgttttcatgaacgagaaggaggatatcctgtggtgcaccgagatggaaagagtgtttggctttccagtgcactacaccgacgtttctaatatgagcagactggccagacaaagactgctgggcagaagctggagcgtgcctgtgatccggcacctgtttgcccctctgaaggaatatttcgcctgtgtgtcttctggcaactctaatgctaacagcagaggacctagcttcagcagcggactggttccactgagcctgagaggcagccatatgggacctatggaaatctacaagaccgtgtccgcttggaagcgccagcccgtgcgggtgctcagcctgtttagaaacatcgacaaggtgctgaaaagcctgggattcctggaatccggatctggcagcggcggcggcaccctgaagtacgtggaagatgtgacaaacgtggttaggcgggacgtcgagaagtggggcccttttgacctggtgtacggctccacccagcccctgggctccagctgtgaccggtgccccggctggtacatgttccagttccacagaatactgcagtacgccctgcctagacaggagagccagcggcctttcttctggatcttcatggacaacctgcttctgaccgaagatgatcaggagacaacaaccagattcctgcagaccgaagccgtgaccctgcaagacgtgcggggccgggactaccagaacgctatgagagtgtggtccaacatccccggcctgaagagcaagcacgcccccctgacccctaaagaagaagagtacctgcaggcccaagtgcggagcagaagcaagctggacgcccctaaggtggatctgctggtgaagaactgtctgctgcctctcagagagtactttaaatacttcagccagaacagcctccctctgggaggacctagcagcggcgccccacctccaagcggaggctctccagctggcagccctaccagcacagaggaaggcacaagcgagagcgccacacctgagagcggccctggcacctccaccgagcccagcgagggctctgcccctggcagccccgccggaagccccacctctacagaagaaggcaccagcacagagccttctgaaggctctgcccctggaacatccaccgagcctagcgagaagcggactgccgatggatctgagtttgagagccctaagaaaaaaagaaaggttggagtgcccgccgccatggccgaacggcctttccagtgcagaatctgcatgaacttcagctacaagtgctgcctgtctgatcacatccggacccacaccggcgagaaaccttttgcctgtgacatctgcggaagaaagttcgcccggagcgctaatctgaccagacataccaagatccacacaggcagccagaaacctttccagtgccggatctgtatgaacttctctagaagcgaccacctgagcgcccacatcagaacacatacaggcgagaagccattcgcttgcgacatctgcggcagaaagtttgctgatagatctgccctggcccggcacaccaagatccacacccaccccagagcccctatccccaagcctttccaatgtcggatctgcatgaacttcagcatcaagcacgacctgcacagacacattcgcacccacaccggcgaaaaaccttttgcctgcgacatctgtggcagaaagttcgccaggtccgccaacctgacaagacacacaaagatccacctgagacagaaggacgccgctagaggcagcggcggagatgccaagagcctgaccgcctggtccaagaggaccgccgacggcagcgagttcgagcccaagaaaaagcggaaggtgtccggctctgaaacccctggcacaagcgagtctgctacacctgagtccagaaccctggtcaccttcaaagacgtgttcgtggacttcaccagagaagaatggaagctgctggataccgctcagcagatcgtgtacagaaacgtgatgctggaaaactacaagaatctggtgtccctgggctaccagctgaccaagcctgacgtgatcctgagactggaaaagggcgaggaacccgctacaaacttcagcctgctgaaacaggccggcgacgtcgaggaaaatcctggccccagcgagctgattaaggaaaacatgcacatgaagctgtatatggaaggcaccgtggacaaccaccatttcaagtgcaccagcgagggcgaaggcaagccctacgagggaacacagaccatgcggatcaaggtggtggaaggcggccctctgcccttcgccttcgacatcctcgccacctctttcctgtacggcagtaagacctttatcaaccacacccagggcatccccgatttcttcaagcagagcttccccgagggatttacctgggagagagtgaccacctacgaggacggcggcgtgctgacagccacccaggacaccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 294 - DNA, 3555 bp, synthetic construct
  misc_feature 1..3555: note = synthetic sequence for use in compositions and/or methods
  source 1..3555: mol_type = other DNA
atgaaccacgaccaggagtttgatcctcctaaggtgtatcctcctgtgcccgcagaaaagcgaaaacctatcagagtgctgtcactgttcgacggcatcgccaccggcctgctggtgctgaaggacctcggcatccaggtggaccggtacatcgctagcgaggtgtgcgaggacagcatcaccgtgggcatggtgaggcaccagggcaagatcatgtacgtgggagatgtgagaagcgtgacccagaaacacatccaggagtggggccccttcgacctggtgatcggcggcagcccctgcaacgacctgagcatcgtgaatccagccagaaagggcctgtacgagggcactggcagactgtttttcgagttctacagactgctgcacgatgccagacctaaagagggagatgacaggcctttcttctggctgttcgagaacgtggtggccatgggcgtgagtgataagagagatatcagcagattcctggaatctaaccccgtcatgatcgacgccaaggaggtgtccgccgcccaccgggccagatacttctggggaaatctgcctggcatgaacagacctcttgcttctaccgtgaacgacaagctggaactgcaggagtgcctggaacacggccggatcgccaaattctccaaggtgagaacaatcaccacaagaagcaacagcattaagcagggaaaggaccaacatttccccgttttcatgaacgagaaggaggatatcctgtggtgcaccgagatggaaagagtgtttggctttccagtgcactacaccgacgtttctaatatgagcagactggccagacaaagactgctgggcagaagctggagcgtgcctgtgatccggcacctgtttgcccctctgaaggaatatttcgcctgtgtgtcttctggcaactctaatgctaacagcagaggacctagcttcagcagcggactggttccactgagcctgagaggcagccatatgggacctatggaaatctacaagaccgtgtccgcttggaagcgccagcccgtgcgggtgctcagcctgtttagaaacatcgacaaggtgctgaaaagcctgggattcctggaatccggatctggcagcggcggcggcaccctgaagtacgtggaagatgtgacaaacgtggttaggcgggacgtcgagaagtggggcccttttgacctggtgtacggctccacccagcccctgggctccagctgtgaccggtgccccggctggtacatgttccagttccacagaatactgcagtacgccctgcctagacaggagagccagcggcctttcttctggatcttcatggacaacctgcttctgaccgaagatgatcaggagacaacaaccagattcctgcagaccgaagccgtgaccctgcaagacgtgcggggccgggactaccagaacgctatgagagtgtggtccaacatccccggcctgaagagcaagcacgcccccctgacccctaaagaagaagagtacctgcaggcccaagtgcggagcagaagcaagctggacgcccctaaggtggatctgctggtgaagaactgtctgctgcctctcagagagtactttaaatacttcagccagaacagcctccctctgggaggacctagcagcggcgccccacctccaagcggaggctctccagctggcagccctaccagcacagaggaaggcacaagcgagagcgccacacctgagagcggccctggcacctccaccgagcccagcgagggctctgcccctggcagccccgccggaagccccacctctacagaagaaggcaccagcacagagccttctgaaggctctgcccctggaacatccaccgagcctagcgagaagcggactgccgatggatctgagtttgagagccctaagaaaaaaagaaaggttggagtgcctgctgctatggccgagcggcctttccagtgtcggatctgtatgcaaaatttcagctaccccaaggacctggccagacacatccggacacacaccggcgaaaagccttttgcctgcgacatctgcggccgcaaattcgctacaagcggcaacctgacaagacatacaaaaatccacaccggctctcaaaagcctttccagtgcaggatctgcatgcagaacttctccaccagcggatctctgagcagacacattagaacccataccggcgagaagccattcgcctgtgacatctgcggcagaaagttcgcccagagcgccgatagaacaaagcacacaaagatccacaccggcagccagaaaccttttcagtgcagaatctgcatgaacttcagccagagcggcgatctgaccagacacatcagaacccacaccggagaaaagccctttgcctgcgatatctgtggccggaagttcgcctaccggtggctgcggaacaaccacaccaagatccacctgagacagaaggacgccgccagaggctctggcggcgacgccaagagcctgaccgcctggtccaagaggaccgccgacggcagcgagttcgagcccaagaaaaagcggaaggtgtccggctctgaaacccctggcacaagcgagtctgctacacctgagtccagaaccctggtcaccttcaaagacgtgttcgtggacttcaccagagaagaatggaagctgctggataccgctcagcagatcgtgtacagaaacgtgatgctggaaaactacaagaatctggtgtccctgggctaccagctgaccaagcctgacgtgatcctgagactggaaaagggcgaggaacccgctacaaacttcagcctgctgaaacaggccggcgacgtcgaggaaaatcctggccccagcgagctgattaaggaaaacatgcacatgaagctgtatatggaaggcaccgtggacaaccaccatttcaagtgcaccagcgagggcgaaggcaagccctacgagggaacacagaccatgcggatcaaggtggtggaaggcggccctctgcccttcgccttcgacatcctcgccacctctttcctgtacggcagtaagacctttatcaaccacacccagggcatccccgatttcttcaagcagagcttccccgagggatttacctgggagagagtgaccacctacgaggacggcggcgtgctgacagccacccaggacaccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 295 - DNA, 3561 bp, synthetic construct
  misc_feature 1..3561: note = synthetic sequence for use in compositions and/or methods
  source 1..3561: mol_type = other DNA
atgaaccacgaccaggagtttgatcctcctaaggtgtatcctcctgtgcccgcagaaaagcgaaaacctatcagagtgctgtcactgttcgacggcatcgccaccggcctgctggtgctgaaggacctcggcatccaggtggaccggtacatcgctagcgaggtgtgcgaggacagcatcaccgtgggcatggtgaggcaccagggcaagatcatgtacgtgggagatgtgagaagcgtgacccagaaacacatccaggagtggggccccttcgacctggtgatcggcggcagcccctgcaacgacctgagcatcgtgaatccagccagaaagggcctgtacgagggcactggcagactgtttttcgagttctacagactgctgcacgatgccagacctaaagagggagatgacaggcctttcttctggctgttcgagaacgtggtggccatgggcgtgagtgataagagagatatcagcagattcctggaatctaaccccgtcatgatcgacgccaaggaggtgtccgccgcccaccgggccagatacttctggggaaatctgcctggcatgaacagacctcttgcttctaccgtgaacgacaagctggaactgcaggagtgcctggaacacggccggatcgccaaattctccaaggtgagaacaatcaccacaagaagcaacagcattaagcagggaaaggaccaacatttccccgttttcatgaacgagaaggaggatatcctgtggtgcaccgagatggaaagagtgtttggctttccagtgcactacaccgacgtttctaatatgagcagactggccagacaaagactgctgggcagaagctggagcgtgcctgtgatccggcacctgtttgcccctctgaaggaatatttcgcctgtgtgtcttctggcaactctaatgctaacagcagaggacctagcttcagcagcggactggttccactgagcctgagaggcagccatatgggacctatggaaatctacaagaccgtgtccgcttggaagcgccagcccgtgcgggtgctcagcctgtttagaaacatcgacaaggtgctgaaaagcctgggattcctggaatccggatctggcagcggcggcggcaccctgaagtacgtggaagatgtgacaaacgtggttaggcgggacgtcgagaagtggggcccttttgacctggtgtacggctccacccagcccctgggctccagctgtgaccggtgccccggctggtacatgttccagttccacagaatactgcagtacgccctgcctagacaggagagccagcggcctttcttctggatcttcatggacaacctgcttctgaccgaagatgatcaggagacaacaaccagattcctgcagaccgaagccgtgaccctgcaagacgtgcggggccgggactaccagaacgctatgagagtgtggtccaacatccccggcctgaagagcaagcacgcccccctgacccctaaagaagaagagtacctgcaggcccaagtgcggagcagaagcaagctggacgcccctaaggtggatctgctggtgaagaactgtctgctgcctctcagagagtactttaaatacttcagccagaacagcctccctctgggaggacctagcagcggcgccccacctccaagcggaggctctccagctggcagccctaccagcacagaggaaggcacaagcgagagcgccacacctgagagcggccctggcacctccaccgagcccagcgagggctctgcccctggcagccccgccggaagccccacctctacagaagaaggcaccagcacagagccttctgaaggctctgcccctggaacatccaccgagcctagcgagaagcggactgccgatggatctgagtttgagagccctaagaaaaaaagaaaggttggcgttccagcagctatggcagaaagaccgtttcagtgccgcatttgcatgaacttttctcgctccgctgatcttacacgacatatccgtacgcataccggcgagaaaccctttgcttgtgatatttgtgggcgaaaatttgctcaaagcggtgatttaactaggcatacgaagatacatacccacccgcgggctcccataccaaaacctttccaatgccgcatttgtatgaattttagcagatcagatcatctctcccgacacattaggacgcatactggggagaaaccctttgcctgtgatatttgtggtaggaaatttgcagaccggagcaaccggaagacccacaccaagatccacaccggatctcagaaaccttttcagtgccggatctgcatgaacttcagcaccagcggcagcctgagccgccacatcagaacacacaccggcgagaagccctttgcttgtgatatctgcggaagaaaattcgctcagaacgccaacctgatgaagcacacaaagatccacctgagacagaaggacgccgctagaggctctggcggcgatgccaagagcctgaccgcctggtccaagaggaccgccgacggcagcgagttcgagcccaagaaaaagcggaaggtgtccggctctgaaacccctggcacaagcgagtctgctacacctgagtccagaaccctggtcaccttcaaagacgtgttcgtggacttcaccagagaagaatggaagctgctggataccgctcagcagatcgtgtacagaaacgtgatgctggaaaactacaagaatctggtgtccctgggctaccagctgaccaagcctgacgtgatcctgagactggaaaagggcgaggaacccgctacaaacttcagcctgctgaaacaggccggcgacgtcgaggaaaatcctggccccagcgagctgattaaggaaaacatgcacatgaagctgtatatggaaggcaccgtggacaaccaccatttcaagtgcaccagcgagggcgaaggcaagccctacgagggaacacagaccatgcggatcaaggtggtggaaggcggccctctgcccttcgccttcgacatcctcgccacctctttcctgtacggcagtaagacctttatcaaccacacccagggcatccccgatttcttcaagcagagcttccccgagggatttacctgggagagagtgaccacctacgaggacggcggcgtgctgacagccacccaggacaccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 296 - DNA, 3558 bp, synthetic construct
  misc_feature 1..3558: note = synthetic sequence for use in compositions and/or methods
  source 1..3558: mol_type = other DNA
atgaaccacgaccaggagtttgatcctcctaaggtgtatcctcctgtgcccgcagaaaagcgaaaacctatcagagtgctgtcactgttcgacggcatcgccaccggcctgctggtgctgaaggacctcggcatccaggtggaccggtacatcgctagcgaggtgtgcgaggacagcatcaccgtgggcatggtgaggcaccagggcaagatcatgtacgtgggagatgtgagaagcgtgacccagaaacacatccaggagtggggccccttcgacctggtgatcggcggcagcccctgcaacgacctgagcatcgtgaatccagccagaaagggcctgtacgagggcactggcagactgtttttcgagttctacagactgctgcacgatgccagacctaaagagggagatgacaggcctttcttctggctgttcgagaacgtggtggccatgggcgtgagtgataagagagatatcagcagattcctggaatctaaccccgtcatgatcgacgccaaggaggtgtccgccgcccaccgggccagatacttctggggaaatctgcctggcatgaacagacctcttgcttctaccgtgaacgacaagctggaactgcaggagtgcctggaacacggccggatcgccaaattctccaaggtgagaacaatcaccacaagaagcaacagcattaagcagggaaaggaccaacatttccccgttttcatgaacgagaaggaggatatcctgtggtgcaccgagatggaaagagtgtttggctttccagtgcactacaccgacgtttctaatatgagcagactggccagacaaagactgctgggcagaagctggagcgtgcctgtgatccggcacctgtttgcccctctgaaggaatatttcgcctgtgtgtcttctggcaactctaatgctaacagcagaggacctagcttcagcagcggactggttccactgagcctgagaggcagccatatgggacctatggaaatctacaagaccgtgtccgcttggaagcgccagcccgtgcgggtgctcagcctgtttagaaacatcgacaaggtgctgaaaagcctgggattcctggaatccggatctggcagcggcggcggcaccctgaagtacgtggaagatgtgacaaacgtggttaggcgggacgtcgagaagtggggcccttttgacctggtgtacggctccacccagcccctgggctccagctgtgaccggtgccccggctggtacatgttccagttccacagaatactgcagtacgccctgcctagacaggagagccagcggcctttcttctggatcttcatggacaacctgcttctgaccgaagatgatcaggagacaacaaccagattcctgcagaccgaagccgtgaccctgcaagacgtgcggggccgggactaccagaacgctatgagagtgtggtccaacatccccggcctgaagagcaagcacgcccccctgacccctaaagaagaagagtacctgcaggcccaagtgcggagcagaagcaagctggacgcccctaaggtggatctgctggtgaagaactgtctgctgcctctcagagagtactttaaatacttcagccagaacagcctccctctgggaggacctagcagcggcgccccacctccaagcggaggctctccagctggcagccctaccagcacagaggaaggcacaagcgagagcgccacacctgagagcggccctggcacctccaccgagcccagcgagggctctgcccctggcagccccgccggaagccccacctctacagaagaaggcaccagcacagagccttctgaaggctctgcccctggaacatccaccgagcctagcgagaagcggactgccgatggatctgagtttgagagccctaagaaaaaaagaaaggttggcgtgcccgccgccatggccgagagacctttccagtgcagaatctgcatgcgcaacttcagcaccagcggccacctgtctagacacatcagaacccacaccggcgaaaagcctttcgcctgtgatatctgcggcagaaagttcgctcaaagcggccacctgagcagacatacaaagatccacaccggaagccagaaaccatttcagtgtagaatctgcatgagaaacttctccgacagaagccacctgacaagacacattcggacccacacaggcgagaaacctttcgcctgcgacatctgcggccggaaattcgcccagagcagcgatctgcggagacacaccaagatccacacaggatctcagaagccctttcagtgccggatctgcatgcggaatttcagcgaccggagctacagaaacacccacatccggacacataccggcgaaaagccttttgcttgtgacatctgtggcagaaagttcgccagaaggtccgacctgaagcggcacaccaagatccacctgagacagaaggacgccgctagaggctctggcggagatgccaagagcctgaccgcctggtccaagaggaccgccgacggcagcgagttcgagcccaagaaaaagcggaaggtgtccggctctgaaacccctggcacaagcgagtctgctacacctgagtccagaaccctggtcaccttcaaagacgtgttcgtggacttcaccagagaagaatggaagctgctggataccgctcagcagatcgtgtacagaaacgtgatgctggaaaactacaagaatctggtgtccctgggctaccagctgaccaagcctgacgtgatcctgagactggaaaagggcgaggaacccgctacaaacttcagcctgctgaaacaggccggcgacgtcgaggaaaatcctggccccagcgagctgattaaggaaaacatgcacatgaagctgtatatggaaggcaccgtggacaaccaccatttcaagtgcaccagcgagggcgaaggcaagccctacgagggaacacagaccatgcggatcaaggtggtggaaggcggccctctgcccttcgccttcgacatcctcgccacctctttcctgtacggcagtaagacctttatcaaccacacccagggcatccccgatttcttcaagcagagcttccccgagggatttacctgggagagagtgaccacctacgaggacggcggcgtgctgacagccacccaggacaccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 297 - DNA, 3555 bp, synthetic construct
  misc_feature 1..3555: note = synthetic sequence for use in compositions and/or methods
  source 1..3555: mol_type = other DNA
atgaaccacgaccaggagtttgatcctcctaaggtgtatcctcctgtgcccgcagaaaagcgaaaacctatcagagtgctgtcactgttcgacggcatcgccaccggcctgctggtgctgaaggacctcggcatccaggtggaccggtacatcgctagcgaggtgtgcgaggacagcatcaccgtgggcatggtgaggcaccagggcaagatcatgtacgtgggagatgtgagaagcgtgacccagaaacacatccaggagtggggccccttcgacctggtgatcggcggcagcccctgcaacgacctgagcatcgtgaatccagccagaaagggcctgtacgagggcactggcagactgtttttcgagttctacagactgctgcacgatgccagacctaaagagggagatgacaggcctttcttctggctgttcgagaacgtggtggccatgggcgtgagtgataagagagatatcagcagattcctggaatctaaccccgtcatgatcgacgccaaggaggtgtccgccgcccaccgggccagatacttctggggaaatctgcctggcatgaacagacctcttgcttctaccgtgaacgacaagctggaactgcaggagtgcctggaacacggccggatcgccaaattctccaaggtgagaacaatcaccacaagaagcaacagcattaagcagggaaaggaccaacatttccccgttttcatgaacgagaaggaggatatcctgtggtgcaccgagatggaaagagtgtttggctttccagtgcactacaccgacgtttctaatatgagcagactggccagacaaagactgctgggcagaagctggagcgtgcctgtgatccggcacctgtttgcccctctgaaggaatatttcgcctgtgtgtcttctggcaactctaatgctaacagcagaggacctagcttcagcagcggactggttccactgagcctgagaggcagccatatgggacctatggaaatctacaagaccgtgtccgcttggaagcgccagcccgtgcgggtgctcagcctgtttagaaacatcgacaaggtgctgaaaagcctgggattcctggaatccggatctggcagcggcggcggcaccctgaagtacgtggaagatgtgacaaacgtggttaggcgggacgtcgagaagtggggcccttttgacctggtgtacggctccacccagcccctgggctccagctgtgaccggtgccccggctggtacatgttccagttccacagaatactgcagtacgccctgcctagacaggagagccagcggcctttcttctggatcttcatggacaacctgcttctgaccgaagatgatcaggagacaacaaccagattcctgcagaccgaagccgtgaccctgcaagacgtgcggggccgggactaccagaacgctatgagagtgtggtccaacatccccggcctgaagagcaagcacgcccccctgacccctaaagaagaagagtacctgcaggcccaagtgcggagcagaagcaagctggacgcccctaaggtggatctgctggtgaagaactgtctgctgcctctcagagagtactttaaatacttcagccagaacagcctccctctgggaggacctagcagcggcgccccacctccaagcggaggctctccagctggcagccctaccagcacagaggaaggcacaagcgagagcgccacacctgagagcggccctggcacctccaccgagcccagcgagggctctgcccctggcagccccgccggaagccccacctctacagaagaaggcaccagcacagagccttctgaaggctctgcccctggaacatccaccgagcctagcgagaagcggactgccgatggatctgagtttgagagccctaagaaaaaaagaaaggttggcgtgcccgccgccatggccgagagacctttccagtgccggatctgcatgcagaacttctccgatagaagcaacctgagccggcacatcagaacacacaccggcgagaagcctttcgcctgcgacatctgtggaaggaagttcgccctgcggcaggacctgaagcggcataccaagatccacacaggctctcagaagccatttcagtgcagaatctgcatgcaaaacttcagcgaccgctccgccctgtctagacacattcggacccacaccggagaaaagccctttgcctgtgatatctgtggcagaaagttcgcccagagcggagatctgaccagacatacaaagatccacacaggcagccagaaacctttccaatgtagaatctgcatgaacttcagcagatctgctaatctcgccagacacatccggacccacaccggcgaaaaaccttttgcctgcgacatctgcggcagaaaattcgctgatagcagcgaccggaaaaagcacacaaagatccacctgagacagaaggacgccgctagaggcagcggcggcgacgcaaagagcctgaccgcctggtccaagaggaccgccgacggcagcgagttcgagcccaagaaaaagcggaaggtgtccggctctgaaacccctggcacaagcgagtctgctacacctgagtccagaaccctggtcaccttcaaagacgtgttcgtggacttcaccagagaagaatggaagctgctggataccgctcagcagatcgtgtacagaaacgtgatgctggaaaactacaagaatctggtgtccctgggctaccagctgaccaagcctgacgtgatcctgagactggaaaagggcgaggaacccgctacaaacttcagcctgctgaaacaggccggcgacgtcgaggaaaatcctggccccagcgagctgattaaggaaaacatgcacatgaagctgtatatggaaggcaccgtggacaaccaccatttcaagtgcaccagcgagggcgaaggcaagccctacgagggaacacagaccatgcggatcaaggtggtggaaggcggccctctgcccttcgccttcgacatcctcgccacctctttcctgtacggcagtaagacctttatcaaccacacccagggcatccccgatttcttcaagcagagcttccccgagggatttacctgggagagagtgaccacctacgaggacggcggcgtgctgacagccacccaggacaccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 298 - DNA, 3561 bp, synthetic construct
  misc_feature 1..3561: note = synthetic sequence for use in compositions and/or methods
  source 1..3561: mol_type = other DNA
atgaaccacgaccaggagtttgatcctcctaaggtgtatcctcctgtgcccgcagaaaagcgaaaacctatcagagtgctgtcactgttcgacggcatcgccaccggcctgctggtgctgaaggacctcggcatccaggtggaccggtacatcgctagcgaggtgtgcgaggacagcatcaccgtgggcatggtgaggcaccagggcaagatcatgtacgtgggagatgtgagaagcgtgacccagaaacacatccaggagtggggccccttcgacctggtgatcggcggcagcccctgcaacgacctgagcatcgtgaatccagccagaaagggcctgtacgagggcactggcagactgtttttcgagttctacagactgctgcacgatgccagacctaaagagggagatgacaggcctttcttctggctgttcgagaacgtggtggccatgggcgtgagtgataagagagatatcagcagattcctggaatctaaccccgtcatgatcgacgccaaggaggtgtccgccgcccaccgggccagatacttctggggaaatctgcctggcatgaacagacctcttgcttctaccgtgaacgacaagctggaactgcaggagtgcctggaacacggccggatcgccaaattctccaaggtgagaacaatcaccacaagaagcaacagcattaagcagggaaaggaccaacatttccccgttttcatgaacgagaaggaggatatcctgtggtgcaccgagatggaaagagtgtttggctttccagtgcactacaccgacgtttctaatatgagcagactggccagacaaagactgctgggcagaagctggagcgtgcctgtgatccggcacctgtttgcccctctgaaggaatatttcgcctgtgtgtcttctggcaactctaatgctaacagcagaggacctagcttcagcagcggactggttccactgagcctgagaggcagccatatgggacctatggaaatctacaagaccgtgtccgcttggaagcgccagcccgtgcgggtgctcagcctgtttagaaacatcgacaaggtgctgaaaagcctgggattcctggaatccggatctggcagcggcggcggcaccctgaagtacgtggaagatgtgacaaacgtggttaggcgggacgtcgagaagtggggcccttttgacctggtgtacggctccacccagcccctgggctccagctgtgaccggtgccccggctggtacatgttccagttccacagaatactgcagtacgccctgcctagacaggagagccagcggcctttcttctggatcttcatggacaacctgcttctgaccgaagatgatcaggagacaacaaccagattcctgcagaccgaagccgtgaccctgcaagacgtgcggggccgggactaccagaacgctatgagagtgtggtccaacatccccggcctgaagagcaagcacgcccccctgacccctaaagaagaagagtacctgcaggcccaagtgcggagcagaagcaagctggacgcccctaaggtggatctgctggtgaagaactgtctgctgcctctcagagagtactttaaatacttcagccagaacagcctccctctgggaggacctagcagcggcgccccacctccaagcggaggctctccagctggcagccctaccagcacagaggaaggcacaagcgagagcgccacacctgagagcggccctggcacctccaccgagcccagcgagggctctgcccctggcagccccgccggaagccccacctctacagaagaaggcaccagcacagagccttctgaaggctctgcccctggaacatccaccgagcctagcgagaagcggactgccgatggatctgagtttgagagccctaagaaaaaaagaaaggttggtgttcccgcagctatggcagaaagaccctttcagtgcaggatttgtatgaacttttctcaatctgggcatttggcccgccatatacgcacacatactggggaaaagcccttcgcttgtgatatttgtggacggaagtttgcacaacttacgcatctcaattcccatactaagattcatacgcacccccgcgcaccaattccgaaaccattccaatgtcgtatatgtatgaacttttcacgctcagataatttggctaggcatattagaacgcataccggtgagaaaccgtttgcgtgcgatatttgcggccgaaaatttgctatgcgtcatcatttggacgatcatactaaaattcatactgggagccaaaagcccttccaatgtcgcatatgtatgaatttcagcctgcggcatcacctgaccagacacatcagaacacatacaggcgaaaagccattcgcctgcgacatctgtggcagaaagttcgcagatagatcctaccgcaacacccacaccaagatccacctgagacagaaggacgctgccaggggcagcggaggagatgccaagagcctgaccgcctggtccaagaggaccgccgacggcagcgagttcgagcccaagaaaaagcggaaggtgtccggctctgaaacccctggcacaagcgagtctgctacacctgagtccagaaccctggtcaccttcaaagacgtgttcgtggacttcaccagagaagaatggaagctgctggataccgctcagcagatcgtgtacagaaacgtgatgctggaaaactacaagaatctggtgtccctgggctaccagctgaccaagcctgacgtgatcctgagactggaaaagggcgaggaacccgctacaaacttcagcctgctgaaacaggccggcgacgtcgaggaaaatcctggccccagcgagctgattaaggaaaacatgcacatgaagctgtatatggaaggcaccgtggacaaccaccatttcaagtgcaccagcgagggcgaaggcaagccctacgagggaacacagaccatgcggatcaaggtggtggaaggcggccctctgcccttcgccttcgacatcctcgccacctctttcctgtacggcagtaagacctttatcaaccacacccagggcatccccgatttcttcaagcagagcttccccgagggatttacctgggagagagtgaccacctacgaggacggcggcgtgctgacagccacccaggacaccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 299 - DNA, 3570 bp, synthetic construct
  misc_feature 1..3570: note = synthetic sequence for use in compositions and/or methods
  source 1..3570: mol_type = other DNA
atgaaccacgaccaggagtttgatcctcctaaggtgtatcctcctgtgcccgcagaaaagcgaaaacctatcagagtgctgtcactgttcgacggcatcgccaccggcctgctggtgctgaaggacctcggcatccaggtggaccggtacatcgctagcgaggtgtgcgaggacagcatcaccgtgggcatggtgaggcaccagggcaagatcatgtacgtgggagatgtgagaagcgtgacccagaaacacatccaggagtggggccccttcgacctggtgatcggcggcagcccctgcaacgacctgagcatcgtgaatccagccagaaagggcctgtacgagggcactggcagactgtttttcgagttctacagactgctgcacgatgccagacctaaagagggagatgacaggcctttcttctggctgttcgagaacgtggtggccatgggcgtgagtgataagagagatatcagcagattcctggaatctaaccccgtcatgatcgacgccaaggaggtgtccgccgcccaccgggccagatacttctggggaaatctgcctggcatgaacagacctcttgcttctaccgtgaacgacaagctggaactgcaggagtgcctggaacacggccggatcgccaaattctccaaggtgagaacaatcaccacaagaagcaacagcattaagcagggaaaggaccaacatttccccgttttcatgaacgagaaggaggatatcctgtggtgcaccgagatggaaagagtgtttggctttccagtgcactacaccgacgtttctaatatgagcagactggccagacaaagactgctgggcagaagctggagcgtgcctgtgatccggcacctgtttgcccctctgaaggaatatttcgcctgtgtgtcttctggcaactctaatgctaacagcagaggacctagcttcagcagcggactggttccactgagcctgagaggcagccatatgggacctatggaaatctacaagaccgtgtccgcttggaagcgccagcccgtgcgggtgctcagcctgtttagaaacatcgacaaggtgctgaaaagcctgggattcctggaatccggatctggcagcggcggcggcaccctgaagtacgtggaagatgtgacaaacgtggttaggcgggacgtcgagaagtggggcccttttgacctggtgtacggctccacccagcccctgggctccagctgtgaccggtgccccggctggtacatgttccagttccacagaatactgcagtacgccctgcctagacaggagagccagcggcctttcttctggatcttcatggacaacctgcttctgaccgaagatgatcaggagacaacaaccagattcctgcagaccgaagccgtgaccctgcaagacgtgcggggccgggactaccagaacgctatgagagtgtggtccaacatccccggcctgaagagcaagcacgcccccctgacccctaaagaagaagagtacctgcaggcccaagtgcggagcagaagcaagctggacgcccctaaggtggatctgctggtgaagaactgtctgctgcctctcagagagtactttaaatacttcagccagaacagcctccctctgggaggacctagcagcggcgccccacctccaagcggaggctctccagctggcagccctaccagcacagaggaaggcacaagcgagagcgccacacctgagagcggccctggcacctccaccgagcccagcgagggctctgcccctggcagccccgccggaagccccacctctacagaagaaggcaccagcacagagccttctgaaggctctgcccctggaacatccaccgagcctagcgagaagcggactgccgatggatctgagtttgagagccctaagaaaaaaagaaaggttggagttcccgcagcaatggcagaaaggcctttccaatgtcgcatttgtatgcgaaattttagccggagcgatgatttgacccgccatatacgaactcatactggagagaaaccttttgcatgcgacatctgcgggcggaaatttgctcaatcatcagatcttcgacgtcataccaaaattcatacaggcagtcaaaagccttttcaatgtaggatttgtatgcgcaactttagtgaccgcagtcatttaacacgccacattcgcactcacaccggcgagaagccatttgcatgtgacatttgtgggcgtaaatttgccaggttggattggcttccaatgcatactaaaatacatactcatccacgagctccgataccaaaaccatttcagtgccgaatttgtatgcgcaattttagcaccagcggcaacctgaccagacacatcagaacccacaccggagagaaaccttttgcctgtgacatctgcggccggaagtttgccgacctgacaacactgagaaagcacaccaagatccacctcagacagaaagacgccgccagaggcagcggcggcgatgccaagagcctgaccgcctggtccaagaggaccgccgacggcagcgagttcgagcccaagaaaaagcggaaggtgtccggctctgaaacccctggcacaagcgagtctgctacacctgagtccagaaccctggtcaccttcaaagacgtgttcgtggacttcaccagagaagaatggaagctgctggataccgctcagcagatcgtgtacagaaacgtgatgctggaaaactacaagaatctggtgtccctgggctaccagctgaccaagcctgacgtgatcctgagactggaaaagggcgaggaacccgctacaaacttcagcctgctgaaacaggccggcgacgtcgaggaaaatcctggccccagcgagctgattaaggaaaacatgcacatgaagctgtatatggaaggcaccgtggacaaccaccatttcaagtgcaccagcgagggcgaaggcaagccctacgagggaacacagaccatgcggatcaaggtggtggaaggcggccctctgcccttcgccttcgacatcctcgccacctctttcctgtacggcagtaagacctttatcaaccacacccagggcatccccgatttcttcaagcagagcttccccgagggatttacctgggagagagtgaccacctacgaggacggcggcgtgctgacagccacccaggacaccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 300 - DNA, 3570 bp, synthetic construct
  misc_feature 1..3570: note = synthetic sequence for use in compositions and/or methods
  source 1..3570: mol_type = other DNA
atgaaccacgaccaggagtttgatcctcctaaggtgtatcctcctgtgcccgcagaaaagcgaaaacctatcagagtgctgtcactgttcgacggcatcgccaccggcctgctggtgctgaaggacctcggcatccaggtggaccggtacatcgctagcgaggtgtgcgaggacagcatcaccgtgggcatggtgaggcaccagggcaagatcatgtacgtgggagatgtgagaagcgtgacccagaaacacatccaggagtggggccccttcgacctggtgatcggcggcagcccctgcaacgacctgagcatcgtgaatccagccagaaagggcctgtacgagggcactggcagactgtttttcgagttctacagactgctgcacgatgccagacctaaagagggagatgacaggcctttcttctggctgttcgagaacgtggtggccatgggcgtgagtgataagagagatatcagcagattcctggaatctaaccccgtcatgatcgacgccaaggaggtgtccgccgcccaccgggccagatacttctggggaaatctgcctggcatgaacagacctcttgcttctaccgtgaacgacaagctggaactgcaggagtgcctggaacacggccggatcgccaaattctccaaggtgagaacaatcaccacaagaagcaacagcattaagcagggaaaggaccaacatttccccgttttcatgaacgagaaggaggatatcctgtggtgcaccgagatggaaagagtgtttggctttccagtgcactacaccgacgtttctaatatgagcagactggccagacaaagactgctgggcagaagctggagcgtgcctgtgatccggcacctgtttgcccctctgaaggaatatttcgcctgtgtgtcttctggcaactctaatgctaacagcagaggacctagcttcagcagcggactggttccactgagcctgagaggcagccatatgggacctatggaaatctacaagaccgtgtccgcttggaagcgccagcccgtgcgggtgctcagcctgtttagaaacatcgacaaggtgctgaaaagcctgggattcctggaatccggatctggcagcggcggcggcaccctgaagtacgtggaagatgtgacaaacgtggttaggcgggacgtcgagaagtggggcccttttgacctggtgtacggctccacccagcccctgggctccagctgtgaccggtgccccggctggtacatgttccagttccacagaatactgcagtacgccctgcctagacaggagagccagcggcctttcttctggatcttcatggacaacctgcttctgaccgaagatgatcaggagacaacaaccagattcctgcagaccgaagccgtgaccctgcaagacgtgcggggccgggactaccagaacgctatgagagtgtggtccaacatccccggcctgaagagcaagcacgcccccctgacccctaaagaagaagagtacctgcaggcccaagtgcggagcagaagcaagctggacgcccctaaggtggatctgctggtgaagaactgtctgctgcctctcagagagtactttaaatacttcagccagaacagcctccctctgggaggacctagcagcggcgccccacctccaagcggaggctctccagctggcagccctaccagcacagaggaaggcacaagcgagagcgccacacctgagagcggccctggcacctccaccgagcccagcgagggctctgcccctggcagccccgccggaagccccacctctacagaagaaggcaccagcacagagccttctgaaggctctgcccctggaacatccaccgagcctagcgagaagcggactgccgatggatctgagtttgagagccctaagaaaaaaagaaaggttggagtgcctgctgctatggccgagagaccatttcagtgcagaatctgcatgcgcaatttcagcaccagcggaaatctcacaagacacatccggacccataccggcgagaagccctttgcctgcgatatctgcggcagaaagttcgctctgtctcaggacctgaaccggcacaccaagatccacacacaccccagagcccctatccccaagcctttccagtgccggatttgcatgcggaacttcagcgacaggtccgccctgagcagacatatcagaacacacaccggcgaaaagccttttgcttgtgatatctgtggcagaaagttcgcccggaacgacgacagaaaaaagcacacaaagatccacaccggatctcagaaacctttccaatgtagaatctgcatgagaaacttcagccagagcggcaacctggccagacacatccggacccacacaggcgaaaagcctttcgcctgtgatatctgcggccggaaattcgcccagagaatcgacctgacccggcacaccaagatccacctgagacagaaggacgccgccagaggcagcggcggcgacgccaagagcctgaccgcctggtccaagaggaccgccgacggcagcgagttcgagcccaagaaaaagcggaaggtgtccggctctgaaacccctggcacaagcgagtctgctacacctgagtccagaaccctggtcaccttcaaagacgtgttcgtggacttcaccagagaagaatggaagctgctggataccgctcagcagatcgtgtacagaaacgtgatgctggaaaactacaagaatctggtgtccctgggctaccagctgaccaagcctgacgtgatcctgagactggaaaagggcgaggaacccgctacaaacttcagcctgctgaaacaggccggcgacgtcgaggaaaatcctggccccagcgagctgattaaggaaaacatgcacatgaagctgtatatggaaggcaccgtggacaaccaccatttcaagtgcaccagcgagggcgaaggcaagccctacgagggaacacagaccatgcggatcaaggtggtggaaggcggccctctgcccttcgccttcgacatcctcgccacctctttcctgtacggcagtaagacctttatcaaccacacccagggcatccccgatttcttcaagcagagcttccccgagggatttacctgggagagagtgaccacctacgaggacggcggcgtgctgacagccacccaggacaccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 301 - DNA, 3558 bp, synthetic construct
  misc_feature 1..3558: note = synthetic sequence for use in compositions and/or methods
  source 1..3558: mol_type = other DNA
atgaaccacgaccaggagtttgatcctcctaaggtgtatcctcctgtgcccgcagaaaagcgaaaacctatcagagtgctgtcactgttcgacggcatcgccaccggcctgctggtgctgaaggacctcggcatccaggtggaccggtacatcgctagcgaggtgtgcgaggacagcatcaccgtgggcatggtgaggcaccagggcaagatcatgtacgtgggagatgtgagaagcgtgacccagaaacacatccaggagtggggccccttcgacctggtgatcggcggcagcccctgcaacgacctgagcatcgtgaatccagccagaaagggcctgtacgagggcactggcagactgtttttcgagttctacagactgctgcacgatgccagacctaaagagggagatgacaggcctttcttctggctgttcgagaacgtggtggccatgggcgtgagtgataagagagatatcagcagattcctggaatctaaccccgtcatgatcgacgccaaggaggtgtccgccgcccaccgggccagatacttctggggaaatctgcctggcatgaacagacctcttgcttctaccgtgaacgacaagctggaactgcaggagtgcctggaacacggccggatcgccaaattctccaaggtgagaacaatcaccacaagaagcaacagcattaagcagggaaaggaccaacatttccccgttttcatgaacgagaaggaggatatcctgtggtgcaccgagatggaaagagtgtttggctttccagtgcactacaccgacgtttctaatatgagcagactggccagacaaagactgctgggcagaagctggagcgtgcctgtgatccggcacctgtttgcccctctgaaggaatatttcgcctgtgtgtcttctggcaactctaatgctaacagcagaggacctagcttcagcagcggactggttccactgagcctgagaggcagccatatgggacctatggaaatctacaagaccgtgtccgcttggaagcgccagcccgtgcgggtgctcagcctgtttagaaacatcgacaaggtgctgaaaagcctgggattcctggaatccggatctggcagcggcggcggcaccctgaagtacgtggaagatgtgacaaacgtggttaggcgggacgtcgagaagtggggcccttttgacctggtgtacggctccacccagcccctgggctccagctgtgaccggtgccccggctggtacatgttccagttccacagaatactgcagtacgccctgcctagacaggagagccagcggcctttcttctggatcttcatggacaacctgcttctgaccgaagatgatcaggagacaacaaccagattcctgcagaccgaagccgtgaccctgcaagacgtgcggggccgggactaccagaacgctatgagagtgtggtccaacatccccggcctgaagagcaagcacgcccccctgacccctaaagaagaagagtacctgcaggcccaagtgcggagcagaagcaagctggacgcccctaaggtggatctgctggtgaagaactgtctgctgcctctcagagagtactttaaatacttcagccagaacagcctccctctgggaggacctagcagcggcgccccacctccaagcggaggctctccagctggcagccctaccagcacagaggaaggcacaagcgagagcgccacacctgagagcggccctggcacctccaccgagcccagcgagggctctgcccctggcagccccgccggaagccccacctctacagaagaaggcaccagcacagagccttctgaaggctctgcccctggaacatccaccgagcctagcgagaagcggactgccgatggatctgagtttgagagccctaagaaaaaaagaaaggttggcgtgcccgccgccatggctgaaagaccttttcagtgcagaatctgtatgaggaacttcagcgaccggtccgccctggccagacacatccgcacccacaccggcgagaagcctttcgcctgcgacatctgcggccggaagttcgccatggcctgctgcagatacgcccacaccaagatccacacaggatctcagaaacctttccagtgccggatctgcatgcggaacttcagcgaccggtctgatctgagcagacatattcggacccataccggcgaaaaaccttttgcctgtgatatctgtggcagaaagttcgctagacggacagatctgcggagacacaccaagatccacaccggaagccagaagccattccaatgtagaatctgcatgagaaatttcagcagcgaggccgacaggtctagacacatcagaacacacaccggcgagaagccctttgcttgcgacatctgcggcagaaaattcgccgatagaagcaacctgacaagacacacaaagatccacctgagacagaaggacgccgctagaggaagcggcggcgacgccaagagcctgaccgcctggtccaagaggaccgccgacggcagcgagttcgagcccaagaaaaagcggaaggtgtccggctctgaaacccctggcacaagcgagtctgctacacctgagtccagaaccctggtcaccttcaaagacgtgttcgtggacttcaccagagaagaatggaagctgctggataccgctcagcagatcgtgtacagaaacgtgatgctggaaaactacaagaatctggtgtccctgggctaccagctgaccaagcctgacgtgatcctgagactggaaaagggcgaggaacccgctacaaacttcagcctgctgaaacaggccggcgacgtcgaggaaaatcctggccccagcgagctgattaaggaaaacatgcacatgaagctgtatatggaaggcaccgtggacaaccaccatttcaagtgcaccagcgagggcgaaggcaagccctacgagggaacacagaccatgcggatcaaggtggtggaaggcggccctctgcccttcgccttcgacatcctcgccacctctttcctgtacggcagtaagacctttatcaaccacacccagggcatccccgatttcttcaagcagagcttccccgagggatttacctgggagagagtgaccacctacgaggacggcggcgtgctgacagccacccaggacaccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 302 - DNA, 3558 bp, synthetic construct
  misc_feature 1..3558: note = synthetic sequence for use in compositions and/or methods
  source 1..3558: mol_type = other DNA
atgaaccacgaccaggagtttgatcctcctaaggtgtatcctcctgtgcccgcagaaaagcgaaaacctatcagagtgctgtcactgttcgacggcatcgccaccggcctgctggtgctgaaggacctcggcatccaggtggaccggtacatcgctagcgaggtgtgcgaggacagcatcaccgtgggcatggtgaggcaccagggcaagatcatgtacgtgggagatgtgagaagcgtgacccagaaacacatccaggagtggggccccttcgacctggtgatcggcggcagcccctgcaacgacctgagcatcgtgaatccagccagaaagggcctgtacgagggcactggcagactgtttttcgagttctacagactgctgcacgatgccagacctaaagagggagatgacaggcctttcttctggctgttcgagaacgtggtggccatgggcgtgagtgataagagagatatcagcagattcctggaatctaaccccgtcatgatcgacgccaaggaggtgtccgccgcccaccgggccagatacttctggggaaatctgcctggcatgaacagacctcttgcttctaccgtgaacgacaagctggaactgcaggagtgcctggaacacggccggatcgccaaattctccaaggtgagaacaatcaccacaagaagcaacagcattaagcagggaaaggaccaacatttccccgttttcatgaacgagaaggaggatatcctgtggtgcaccgagatggaaagagtgtttggctttccagtgcactacaccgacgtttctaatatgagcagactggccagacaaagactgctgggcagaagctggagcgtgcctgtgatccggcacctgtttgcccctctgaaggaatatttcgcctgtgtgtcttctggcaactctaatgctaacagcagaggacctagcttcagcagcggactggttccactgagcctgagaggcagccatatgggacctatggaaatctacaagaccgtgtccgcttggaagcgccagcccgtgcgggtgctcagcctgtttagaaacatcgacaaggtgctgaaaagcctgggattcctggaatccggatctggcagcggcggcggcaccctgaagtacgtggaagatgtgacaaacgtggttaggcgggacgtcgagaagtggggcccttttgacctggtgtacggctccacccagcccctgggctccagctgtgaccggtgccccggctggtacatgttccagttccacagaatactgcagtacgccctgcctagacaggagagccagcggcctttcttctggatcttcatggacaacctgcttctgaccgaagatgatcaggagacaacaaccagattcctgcagaccgaagccgtgaccctgcaagacgtgcggggccgggactaccagaacgctatgagagtgtggtccaacatccccggcctgaagagcaagcacgcccccctgacccctaaagaagaagagtacctgcaggcccaagtgcggagcagaagcaagctggacgcccctaaggtggatctgctggtgaagaactgtctgctgcctctcagagagtactttaaatacttcagccagaacagcctccctctgggaggacctagcagcggcgccccacctccaagcggaggctctccagctggcagccctaccagcacagaggaaggcacaagcgagagcgccacacctgagagcggccctggcacctccaccgagcccagcgagggctctgcccctggcagccccgccggaagccccacctctacagaagaaggcaccagcacagagccttctgaaggctctgcccctggaacatccaccgagcctagcgagaagcggactgccgatggatctgagtttgagagccctaagaaaaaaagaaaggttggcgtgcccgctgctatggccgagcggcctttccagtgtagaatctgcatgcgcaatttcagcagatctgaccacctgagcgagcacattcggacacacaccggagagaagccttttgcctgcgatatctgtggaagaaagttcgcctacagctggcggctgtcccagcacaccaagatccacaccggctctcaaaaaccctttcagtgcaggatctgtatgcggaacttcagcctgcggcaccacctgaccagacacatccggacccacactggggagaaaccctttgcttgcgacatttgtggacgtaaatttgcccaaagtgggacccgcaaaacgcataccaagattcatacaggaagccaaaagccattccaatgtcggatatgtatgaggaattttagcagatcagacgtcttgtccaaacatattcgcactcacaccggggagaaaccttttgcgtgtgatatttgtggtaggaaatttgcgagaagcgacgacagaatcaagcacaccaagatccatctgagacagaaagacgccgccagaggcagcggcggcgacgccaagagcctgacagcctggtccaagaggaccgccgacggcagcgagttcgagcccaagaaaaagcggaaggtgtccggctctgaaacccctggcacaagcgagtctgctacacctgagtccagaaccctggtcaccttcaaagacgtgttcgtggacttcaccagagaagaatggaagctgctggataccgctcagcagatcgtgtacagaaacgtgatgctggaaaactacaagaatctggtgtccctgggctaccagctgaccaagcctgacgtgatcctgagactggaaaagggcgaggaacccgctacaaacttcagcctgctgaaacaggccggcgacgtcgaggaaaatcctggccccagcgagctgattaaggaaaacatgcacatgaagctgtatatggaaggcaccgtggacaaccaccatttcaagtgcaccagcgagggcgaaggcaagccctacgagggaacacagaccatgcggatcaaggtggtggaaggcggccctctgcccttcgccttcgacatcctcgccacctctttcctgtacggcagtaagacctttatcaaccacacccagggcatccccgatttcttcaagcagagcttccccgagggatttacctgggagagagtgaccacctacgaggacggcggcgtgctgacagccacccaggacaccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 303 - DNA, 3570 bp, synthetic construct
  misc_feature 1..3570: note = synthetic sequence for use in compositions and/or methods
  source 1..3570: mol_type = other DNA
atgaaccacgaccaggagtttgatcctcctaaggtgtatcctcctgtgcccgcagaaaagcgaaaacctatcagagtgctgtcactgttcgacggcatcgccaccggcctgctggtgctgaaggacctcggcatccaggtggaccggtacatcgctagcgaggtgtgcgaggacagcatcaccgtgggcatggtgaggcaccagggcaagatcatgtacgtgggagatgtgagaagcgtgacccagaaacacatccaggagtggggccccttcgacctggtgatcggcggcagcccctgcaacgacctgagcatcgtgaatccagccagaaagggcctgtacgagggcactggcagactgtttttcgagttctacagactgctgcacgatgccagacctaaagagggagatgacaggcctttcttctggctgttcgagaacgtggtggccatgggcgtgagtgataagagagatatcagcagattcctggaatctaaccccgtcatgatcgacgccaaggaggtgtccgccgcccaccgggccagatacttctggggaaatctgcctggcatgaacagacctcttgcttctaccgtgaacgacaagctggaactgcaggagtgcctggaacacggccggatcgccaaattctccaaggtgagaacaatcaccacaagaagcaacagcattaagcagggaaaggaccaacatttccccgttttcatgaacgagaaggaggatatcctgtggtgcaccgagatggaaagagtgtttggctttccagtgcactacaccgacgtttctaatatgagcagactggccagacaaagactgctgggcagaagctggagcgtgcctgtgatccggcacctgtttgcccctctgaaggaatatttcgcctgtgtgtcttctggcaactctaatgctaacagcagaggacctagcttcagcagcggactggttccactgagcctgagaggcagccatatgggacctatggaaatctacaagaccgtgtccgcttggaagcgccagcccgtgcgggtgctcagcctgtttagaaacatcgacaaggtgctgaaaagcctgggattcctggaatccggatctggcagcggcggcggcaccctgaagtacgtggaagatgtgacaaacgtggttaggcgggacgtcgagaagtggggcccttttgacctggtgtacggctccacccagcccctgggctccagctgtgaccggtgccccggctggtacatgttccagttccacagaatactgcagtacgccctgcctagacaggagagccagcggcctttcttctggatcttcatggacaacctgcttctgaccgaagatgatcaggagacaacaaccagattcctgcagaccgaagccgtgaccctgcaagacgtgcggggccgggactaccagaacgctatgagagtgtggtccaacatccccggcctgaagagcaagcacgcccccctgacccctaaagaagaagagtacctgcaggcccaagtgcggagcagaagcaagctggacgcccctaaggtggatctgctggtgaagaactgtctgctgcctctcagagagtactttaaatacttcagccagaacagcctccctctgggaggacctagcagcggcgccccacctccaagcggaggctctccagctggcagccctaccagcacagaggaaggcacaagcgagagcgccacacctgagagcggccctggcacctccaccgagcccagcgagggctctgcccctggcagccccgccggaagccccacctctacagaagaaggcaccagcacagagccttctgaaggctctgcccctggaacatccaccgagcctagcgagaagcggactgccgatggatctgagtttgagagccctaagaaaaaaagaaaggttggagtgcccgccgctatggccgagcggccttttcagtgcagaatctgcatgcagaatttctcttggaacagcgatctgagaaagcatattaggacgcatacaggggagaaaccattcgcgtgcgacatctgcggcagaaagttcgcccagagcggcaacctggccagacacaccaagatccacacaggctctcagaaacctttccaatgtagaatctgcatgcagaacttcagccagagcagcgacctgtcacggcatattaggacccatacaggtgagaaacccttcgcatgtgacatctgtggaagaaagttcgcccacagaagcacaagaaaccggcacaccaaaatccacacacatcctagagcccctatccccaagcctttccagtgccggatctgcatgcaaaatttcagccggtctgacgacctgtccagacatattcggacccacaccggcgagaagccattcgcctgtgatatctgcggcagaaaattcgctcagtccgccaaccgcaccaagcacaccaagatccacctgcggcagaaggacgccgccaggggcagcggcggagatgccaagagcctgaccgcctggtccaagaggaccgccgacggcagcgagttcgagcccaagaaaaagcggaaggtgtccggctctgaaacccctggcacaagcgagtctgctacacctgagtccagaaccctggtcaccttcaaagacgtgttcgtggacttcaccagagaagaatggaagctgctggataccgctcagcagatcgtgtacagaaacgtgatgctggaaaactacaagaatctggtgtccctgggctaccagctgaccaagcctgacgtgatcctgagactggaaaagggcgaggaacccgctacaaacttcagcctgctgaaacaggccggcgacgtcgaggaaaatcctggccccagcgagctgattaaggaaaacatgcacatgaagctgtatatggaaggcaccgtggacaaccaccatttcaagtgcaccagcgagggcgaaggcaagccctacgagggaacacagaccatgcggatcaaggtggtggaaggcggccctctgcccttcgccttcgacatcctcgccacctctttcctgtacggcagtaagacctttatcaaccacacccagggcatccccgatttcttcaagcagagcttccccgagggatttacctgggagagagtgaccacctacgaggacggcggcgtgctgacagccacccaggacaccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 304 - DNA, 3558 bp, synthetic construct
  misc_feature 1..3558: note = synthetic sequence for use in compositions and/or methods
  source 1..3558: mol_type = other DNA
atgaaccacgaccaggagtttgatcctcctaaggtgtatcctcctgtgcccgcagaaaagcgaaaacctatcagagtgctgtcactgttcgacggcatcgccaccggcctgctggtgctgaaggacctcggcatccaggtggaccggtacatcgctagcgaggtgtgcgaggacagcatcaccgtgggcatggtgaggcaccagggcaagatcatgtacgtgggagatgtgagaagcgtgacccagaaacacatccaggagtggggccccttcgacctggtgatcggcggcagcccctgcaacgacctgagcatcgtgaatccagccagaaagggcctgtacgagggcactggcagactgtttttcgagttctacagactgctgcacgatgccagacctaaagagggagatgacaggcctttcttctggctgttcgagaacgtggtggccatgggcgtgagtgataagagagatatcagcagattcctggaatctaaccccgtcatgatcgacgccaaggaggtgtccgccgcccaccgggccagatacttctggggaaatctgcctggcatgaacagacctcttgcttctaccgtgaacgacaagctggaactgcaggagtgcctggaacacggccggatcgccaaattctccaaggtgagaacaatcaccacaagaagcaacagcattaagcagggaaaggaccaacatttccccgttttcatgaacgagaaggaggatatcctgtggtgcaccgagatggaaagagtgtttggctttccagtgcactacaccgacgtttctaatatgagcagactggccagacaaagactgctgggcagaagctggagcgtgcctgtgatccggcacctgtttgcccctctgaaggaatatttcgcctgtgtgtcttctggcaactctaatgctaacagcagaggacctagcttcagcagcggactggttccactgagcctgagaggcagccatatgggacctatggaaatctacaagaccgtgtccgcttggaagcgccagcccgtgcgggtgctcagcctgtttagaaacatcgacaaggtgctgaaaagcctgggattcctggaatccggatctggcagcggcggcggcaccctgaagtacgtggaagatgtgacaaacgtggttaggcgggacgtcgagaagtggggcccttttgacctggtgtacggctccacccagcccctgggctccagctgtgaccggtgccccggctggtacatgttccagttccacagaatactgcagtacgccctgcctagacaggagagccagcggcctttcttctggatcttcatggacaacctgcttctgaccgaagatgatcaggagacaacaaccagattcctgcagaccgaagccgtgaccctgcaagacgtgcggggccgggactaccagaacgctatgagagtgtggtccaacatccccggcctgaagagcaagcacgcccccctgacccctaaagaagaagagtacctgcaggcccaagtgcggagcagaagcaagctggacgcccctaaggtggatctgctggtgaagaactgtctgctgcctctcagagagtactttaaatacttcagccagaacagcctccctctgggaggacctagcagcggcgccccacctccaagcggaggctctccagctggcagccctaccagcacagaggaaggcacaagcgagagcgccacacctgagagcggccctggcacctccaccgagcccagcgagggctctgcccctggcagccccgccggaagccccacctctacagaagaaggcaccagcacagagccttctgaaggctctgcccctggaacatccaccgagcctagcgagaagcggactgccgatggatctgagtttgagagccctaagaaaaaaagaaaggttggcgtgcctgccgccatggccgagcggcctttccagtgcagaatctgtatgcggaacttctctagaagcgccgacctgaccagacacatcagaacacacacaggagaaaagccatttgcctgcgacatctgcggcagaaagttcgctgatagatctgccctggctcggcatactaaaattcatacgggatctcagaagccttttcagtgtagaatctgcatgcggaacttcagccagagcggccacctggccaggcatattcggacacacaccggcgaaaagcccttcgcctgtgacatctgcggaagaaagttcgcccagaagggcaccctgggtgaacatacaaagattcatacggggagtcaaaagcctttccagtgccggatctgcatgagaaatttcagcatccgctccaccctgagagatcacatccggacccacaccggagagaagccttttgcttgtgatatctgcggcagaaaattcgcccacagaagcagcctgcggagacataccaagatccacctgagacagaaggacgccgctagaggctctggcggcgacgccaagagcctcacagcctggtccaagaggaccgccgacggcagcgagttcgagcccaagaaaaagcggaaggtgtccggctctgaaacccctggcacaagcgagtctgctacacctgagtccagaaccctggtcaccttcaaagacgtgttcgtggacttcaccagagaagaatggaagctgctggataccgctcagcagatcgtgtacagaaacgtgatgctggaaaactacaagaatctggtgtccctgggctaccagctgaccaagcctgacgtgatcctgagactggaaaagggcgaggaacccgctacaaacttcagcctgctgaaacaggccggcgacgtcgaggaaaatcctggccccagcgagctgattaaggaaaacatgcacatgaagctgtatatggaaggcaccgtggacaaccaccatttcaagtgcaccagcgagggcgaaggcaagccctacgagggaacacagaccatgcggatcaaggtggtggaaggcggccctctgcccttcgccttcgacatcctcgccacctctttcctgtacggcagtaagacctttatcaaccacacccagggcatccccgatttcttcaagcagagcttccccgagggatttacctgggagagagtgaccacctacgaggacggcggcgtgctgacagccacccaggacaccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 305 - DNA, 6105 bp, synthetic construct
  misc_feature 1..6105: note = synthetic sequence for use in compositions and/or methods
  source 1..6105: mol_type = other DNA
atggcccggacaaaacaaacggcgagaaaaagcacaggcggaggtggcggcagcggaggaggaggttccggcggagggggttctggacctatggaaatctacaagaccgtgtccgcttggaagcgccagcccgtgcgggtgctcagcctgtttagaaacatcgacaaggtgctgaaaagcctgggattcctggaatccggatctggcagcggcggcggcaccctgaagtacgtggaagatgtgacaaacgtggttaggcgggacgtcgagaagtggggcccttttgacctggtgtacggctccacccagcccctgggctccagctgtgaccggtgccccggctggtacatgttccagttccacagaatactgcagtacgccctgcctagacaggagagccagcggcctttcttctggatcttcatggacaacctgcttctgaccgaagatgatcaggagacaacaaccagattcctgcagaccgaagccgtgaccctgcaagacgtgcggggccgggactaccagaacgctatgagagtgtggtccaacatccccggcctgaagagcaagcacgcccccctgacccctaaagaagaagagtacctgcaggcccaggtccggtcccggagcaagctggacgcccctaaggtggacctgctggtgaagaactgcctgctgcctctgcgggaatacttcaagtacttctctcagaacagcctgcccctgggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtgtccggctctgaaacccctggaacctccgagagcgccacacctgaaagcagaaccctggtgaccttcaaggacgtgttcgtggacttcacccgcgaggaatggaagctcctggacaccgcccagcaaatcgtgtaccggaacgtgatgctggagaattacaagaacctggtgtctctgggctaccagctgacgaagcctgacgtcatcctgagactggaaaagggagaggagcctgccacaaatttcagcctgctgaagcaggccggcgacgtggaagagaatcctggccccagcgagctgatcaaagagaacatgcacatgaagctgtacatggaaggcaccgtggacaaccatcacttcaagtgcaccagcgagggcgagggcaagccctacgagggcacacagaccatgagaatcaaggtggtggaaggaggcccactgcccttcgccttcgacatcctggccaccagctttctgtacggctcaaagaccttcatcaaccacacccagggcatccctgatttcttcaagcagagcttccctgagggatttacctgggagagagtgacaacttatgaagatggcggagtgctgaccgccacacaagataccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 306 - DNA, 6108 bp, synthetic construct
  misc_feature 1..6108: note = synthetic sequence for use in compositions and/or methods
  source 1..6108: mol_type = other DNA
atggctcggaccaagcagaccgccagaaagtccaccggatctggcagcgagacacccggcaccagcgaaagcgccacacctgagagcggacctatggaaatctacaagaccgtgtccgcttggaagcgccagcccgtgcgggtgctcagcctgtttagaaacatcgacaaggtgctgaaaagcctgggattcctggaatccggatctggcagcggcggcggcaccctgaagtacgtggaagatgtgacaaacgtggttaggcgggacgtcgagaagtggggcccttttgacctggtgtacggctccacccagcccctgggctccagctgtgaccggtgccccggctggtacatgttccagttccacagaatactgcagtacgccctgcctagacaggagagccagcggcctttcttctggatcttcatggacaacctgcttctgaccgaagatgatcaggagacaacaaccagattcctgcagaccgaagccgtgaccctgcaagacgtgcggggccgggactaccagaacgctatgagagtgtggtccaacatccccggcctgaagagcaagcacgcccccctgacccctaaagaagaagagtacctgcaggcccaggtccggtcccggagcaagctggacgcccctaaggtggacctgctggtgaagaactgcctgctgcctctgcgggaatacttcaagtacttctctcagaacagcctgcccctgggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtgtccggctctgaaacccctggaacctccgagagcgccacacctgaaagcagaaccctggtgaccttcaaggacgtgttcgtggacttcacccgcgaggaatggaagctcctggacaccgcccagcaaatcgtgtaccggaacgtgatgctggagaattacaagaacctggtgtctctgggctaccagctgacgaagcctgacgtcatcctgagactggaaaagggagaggagcctgccacaaatttcagcctgctgaagcaggccggcgacgtggaagagaatcctggccccagcgagctgatcaaagagaacatgcacatgaagctgtacatggaaggcaccgtggacaaccatcacttcaagtgcaccagcgagggcgagggcaagccctacgagggcacacagaccatgagaatcaaggtggtggaaggaggcccactgcccttcgccttcgacatcctggccaccagctttctgtacggctcaaagaccttcatcaaccacacccagggcatccctgatttcttcaagcagagcttccctgagggatttacctgggagagagtgacaacttatgaagatggcggagtgctgaccgccacacaagataccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 307 - DNA, 6180 bp, synthetic construct
  misc_feature 1..6180: note = synthetic sequence for use in compositions and/or methods
  source 1..6180: mol_type = other DNA
atggctcggaccaagcagaccgccagaaagagcaccggcggcggacctagcagcggcgcccctcctccatctggcggatctcctgccggcagccccacatccaccgaggaaggcacaagcgagtccgccacccctgaaagcggccccggcaccagcacaggacctatggaaatctacaagaccgtgtccgcttggaagcgccagcccgtgcgggtgctcagcctgtttagaaacatcgacaaggtgctgaaaagcctgggattcctggaatccggatctggcagcggcggcggcaccctgaagtacgtggaagatgtgacaaacgtggttaggcgggacgtcgagaagtggggcccttttgacctggtgtacggctccacccagcccctgggctccagctgtgaccggtgccccggctggtacatgttccagttccacagaatactgcagtacgccctgcctagacaggagagccagcggcctttcttctggatcttcatggacaacctgcttctgaccgaagatgatcaggagacaacaaccagattcctgcagaccgaagccgtgaccctgcaagacgtgcggggccgggactaccagaacgctatgagagtgtggtccaacatccccggcctgaagagcaagcacgcccccctgacccctaaagaagaagagtacctgcaggcccaggtccggtcccggagcaagctggacgcccctaaggtggacctgctggtgaagaactgcctgctgcctctgcgggaatacttcaagtacttctctcagaacagcctgcccctgggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtgtccggctctgaaacccctggaacctccgagagcgccacacctgaaagcagaaccctggtgaccttcaaggacgtgttcgtggacttcacccgcgaggaatggaagctcctggacaccgcccagcaaatcgtgtaccggaacgtgatgctggagaattacaagaacctggtgtctctgggctaccagctgacgaagcctgacgtcatcctgagactggaaaagggagaggagcctgccacaaatttcagcctgctgaagcaggccggcgacgtggaagagaatcctggccccagcgagctgatcaaagagaacatgcacatgaagctgtacatggaaggcaccgtggacaaccatcacttcaagtgcaccagcgagggcgagggcaagccctacgagggcacacagaccatgagaatcaaggtggtggaaggaggcccactgcccttcgccttcgacatcctggccaccagctttctgtacggctcaaagaccttcatcaaccacacccagggcatccctgatttcttcaagcagagcttccctgagggatttacctgggagagagtgacaacttatgaagatggcggagtgctgaccgccacacaagataccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 308 - DNA, 6300 bp, synthetic construct
  misc_feature 1..6300: note = synthetic sequence for use in compositions and/or methods
  source 1..6300: mol_type = other DNA
atggcccgcactaagcagacagctcgcaaatctaccggaggcggtccaagttccggtgcgccgccaccgtctgggggaagccccgccggcagccccaccagcaccgaggaaggcacctctgaaagcgctacacctgagagcggacctggcacaagcaccgaaccttctgagggcagcgcccctggatctcctgctggctccccaacaagcacagaggaaggaaccagcaccgagcccagcgagggctctgcccctggcacctccacagaaccctccgagggacctatggaaatctacaagaccgtgtccgcttggaagcgccagcccgtgcgggtgctcagcctgtttagaaacatcgacaaggtgctgaaaagcctgggattcctggaatccggatctggcagcggcggcggcaccctgaagtacgtggaagatgtgacaaacgtggttaggcgggacgtcgagaagtggggcccttttgacctggtgtacggctccacccagcccctgggctccagctgtgaccggtgccccggctggtacatgttccagttccacagaatactgcagtacgccctgcctagacaggagagccagcggcctttcttctggatcttcatggacaacctgcttctgaccgaagatgatcaggagacaacaaccagattcctgcagaccgaagccgtgaccctgcaagacgtgcggggccgggactaccagaacgctatgagagtgtggtccaacatccccggcctgaagagcaagcacgcccccctgacccctaaagaagaagagtacctgcaggcccaggtccggtcccggagcaagctggacgcccctaaggtggacctgctggtgaagaactgcctgctgcctctgcgggaatacttcaagtacttctctcagaacagcctgcccctgggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtgtccggctctgaaacccctggaacctccgagagcgccacacctgaaagcagaaccctggtgaccttcaaggacgtgttcgtggacttcacccgcgaggaatggaagctcctggacaccgcccagcaaatcgtgtaccggaacgtgatgctggagaattacaagaacctggtgtctctgggctaccagctgacgaagcctgacgtcatcctgagactggaaaagggagaggagcctgccacaaatttcagcctgctgaagcaggccggcgacgtggaagagaatcctggccccagcgagctgatcaaagagaacatgcacatgaagctgtacatggaaggcaccgtggacaaccatcacttcaagtgcaccagcgagggcgagggcaagccctacgagggcacacagaccatgagaatcaaggtggtggaaggaggcccactgcccttcgccttcgacatcctggccaccagctttctgtacggctcaaagaccttcatcaaccacacccagggcatccctgatttcttcaagcagagcttccctgagggatttacctgggagagagtgacaacttatgaagatggcggagtgctgaccgccacacaagataccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 309 - DNA, 5871 bp, synthetic construct
  misc_feature 1..5871: note = synthetic sequence for use in compositions and/or methods
  source 1..5871: mol_type = other DNA
atggcccggacaaaacaaacggcgagaaaaagcacaggcggaggtggcggcagcggaggaggaggttccggcggagggggttctggacctatggaaatctacaagaccgtgtccgcttggaagcgccagcccgtgcgggtgctcagcctgtttagaaacatcgacaaggtgctgaaaagcctgggattcctggaatccggatctggcagcggcggcggcaccctgaagtacgtggaagatgtgacaaacgtggttaggcgggacgtcgagaagtggggcccttttgacctggtgtacggctccacccagcccctgggctccagctgtgaccggtgccccggctggtacatgttccagttccacagaatactgcagtacgccctgcctagacaggagagccagcggcctttcttctggatcttcatggacaacctgcttctgaccgaagatgatcaggagacaacaaccagattcctgcagaccgaagccgtgaccctgcaagacgtgcggggccgggactaccagaacgctatgagagtgtggtccaacatccccggcctgaagagcaagcacgcccccctgacccctaaagaagaagagtacctgcaggcccaggtccggtcccggagcaagctggacgcccctaaggtggacctgctggtgaagaactgcctgctgcctctgcgggaatacttcaagtacttctctcagaacagcctgcccctgggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtggccacaaatttcagcctgctgaagcaggccggcgacgtggaagagaatcctggccccagcgagctgatcaaagagaacatgcacatgaagctgtacatggaaggcaccgtggacaaccatcacttcaagtgcaccagcgagggcgagggcaagccctacgagggcacacagaccatgagaatcaaggtggtggaaggaggcccactgcccttcgccttcgacatcctggccaccagctttctgtacggctcaaagaccttcatcaaccacacccagggcatccctgatttcttcaagcagagcttccctgagggatttacctgggagagagtgacaacttatgaagatggcggagtgctgaccgccacacaagataccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 310 - DNA, 5874 bp, synthetic construct
  misc_feature 1..5874: note = synthetic sequence for use in compositions and/or methods
  source 1..5874: mol_type = other DNA
atggctcggaccaagcagaccgccagaaagtccaccggatctggcagcgagacacccggcaccagcgaaagcgccacacctgagagcggacctatggaaatctacaagaccgtgtccgcttggaagcgccagcccgtgcgggtgctcagcctgtttagaaacatcgacaaggtgctgaaaagcctgggattcctggaatccggatctggcagcggcggcggcaccctgaagtacgtggaagatgtgacaaacgtggttaggcgggacgtcgagaagtggggcccttttgacctggtgtacggctccacccagcccctgggctccagctgtgaccggtgccccggctggtacatgttccagttccacagaatactgcagtacgccctgcctagacaggagagccagcggcctttcttctggatcttcatggacaacctgcttctgaccgaagatgatcaggagacaacaaccagattcctgcagaccgaagccgtgaccctgcaagacgtgcggggccgggactaccagaacgctatgagagtgtggtccaacatccccggcctgaagagcaagcacgcccccctgacccctaaagaagaagagtacctgcaggcccaggtccggtcccggagcaagctggacgcccctaaggtggacctgctggtgaagaactgcctgctgcctctgcgggaatacttcaagtacttctctcagaacagcctgcccctgggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtggccacaaatttcagcctgctgaagcaggccggcgacgtggaagagaatcctggccccagcgagctgatcaaagagaacatgcacatgaagctgtacatggaaggcaccgtggacaaccatcacttcaagtgcaccagcgagggcgagggcaagccctacgagggcacacagaccatgagaatcaaggtggtggaaggaggcccactgcccttcgccttcgacatcctggccaccagctttctgtacggctcaaagaccttcatcaaccacacccagggcatccctgatttcttcaagcagagcttccctgagggatttacctgggagagagtgacaacttatgaagatggcggagtgctgaccgccacacaagataccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 311 - DNA, 5946 bp, synthetic construct
  misc_feature 1..5946: note = synthetic sequence for use in compositions and/or methods
  source 1..5946: mol_type = other DNA
atggctcggaccaagcagaccgccagaaagagcaccggcggcggacctagcagcggcgcccctcctccatctggcggatctcctgccggcagccccacatccaccgaggaaggcacaagcgagtccgccacccctgaaagcggccccggcaccagcacaggacctatggaaatctacaagaccgtgtccgcttggaagcgccagcccgtgcgggtgctcagcctgtttagaaacatcgacaaggtgctgaaaagcctgggattcctggaatccggatctggcagcggcggcggcaccctgaagtacgtggaagatgtgacaaacgtggttaggcgggacgtcgagaagtggggcccttttgacctggtgtacggctccacccagcccctgggctccagctgtgaccggtgccccggctggtacatgttccagttccacagaatactgcagtacgccctgcctagacaggagagccagcggcctttcttctggatcttcatggacaacctgcttctgaccgaagatgatcaggagacaacaaccagattcctgcagaccgaagccgtgaccctgcaagacgtgcggggccgggactaccagaacgctatgagagtgtggtccaacatccccggcctgaagagcaagcacgcccccctgacccctaaagaagaagagtacctgcaggcccaggtccggtcccggagcaagctggacgcccctaaggtggacctgctggtgaagaactgcctgctgcctctgcgggaatacttcaagtacttctctcagaacagcctgcccctgggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtggccacaaatttcagcctgctgaagcaggccggcgacgtggaagagaatcctggccccagcgagctgatcaaagagaacatgcacatgaagctgtacatggaaggcaccgtggacaaccatcacttcaagtgcaccagcgagggcgagggcaagccctacgagggcacacagaccatgagaatcaaggtggtggaaggaggcccactgcccttcgccttcgacatcctggccaccagctttctgtacggctcaaagaccttcatcaaccacacccagggcatccctgatttcttcaagcagagcttccctgagggatttacctgggagagagtgacaacttatgaagatggcggagtgctgaccgccacacaagataccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 312 - DNA, 6066 bp, synthetic construct
  misc_feature 1..6066: note = synthetic sequence for use in compositions and/or methods
  source 1..6066: mol_type = other DNA
atggcccgcactaagcagacagctcgcaaatctaccggaggcggtccaagttccggtgcgccgccaccgtctgggggaagccccgccggcagccccaccagcaccgaggaaggcacctctgaaagcgctacacctgagagcggacctggcacaagcaccgaaccttctgagggcagcgcccctggatctcctgctggctccccaacaagcacagaggaaggaaccagcaccgagcccagcgagggctctgcccctggcacctccacagaaccctccgagggacctatggaaatctacaagaccgtgtccgcttggaagcgccagcccgtgcgggtgctcagcctgtttagaaacatcgacaaggtgctgaaaagcctgggattcctggaatccggatctggcagcggcggcggcaccctgaagtacgtggaagatgtgacaaacgtggttaggcgggacgtcgagaagtggggcccttttgacctggtgtacggctccacccagcccctgggctccagctgtgaccggtgccccggctggtacatgttccagttccacagaatactgcagtacgccctgcctagacaggagagccagcggcctttcttctggatcttcatggacaacctgcttctgaccgaagatgatcaggagacaacaaccagattcctgcagaccgaagccgtgaccctgcaagacgtgcggggccgggactaccagaacgctatgagagtgtggtccaacatccccggcctgaagagcaagcacgcccccctgacccctaaagaagaagagtacctgcaggcccaggtccggtcccggagcaagctggacgcccctaaggtggacctgctggtgaagaactgcctgctgcctctgcgggaatacttcaagtacttctctcagaacagcctgcccctgggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtggccacaaatttcagcctgctgaagcaggccggcgacgtggaagagaatcctggccccagcgagctgatcaaagagaacatgcacatgaagctgtacatggaaggcaccgtggacaaccatcacttcaagtgcaccagcgagggcgagggcaagccctacgagggcacacagaccatgagaatcaaggtggtggaaggaggcccactgcccttcgccttcgacatcctggccaccagctttctgtacggctcaaagaccttcatcaaccacacccagggcatccctgatttcttcaagcagagcttccctgagggatttacctgggagagagtgacaacttatgaagatggcggagtgctgaccgccacacaagataccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 313 - DNA, 3525 bp, synthetic construct
  misc_feature 1..3525: note = synthetic sequence for use in compositions and/or methods
  source 1..3525: mol_type = other DNA
atgaaccacgaccaggagtttgatcctcctaaggtgtatcctcctgtgcccgcagaaaagcgaaaacctatcagagtgctgtcactgttcgacggcatcgccaccggcctgctggtgctgaaggacctcggcatccaggtggaccggtacatcgctagcgaggtgtgcgaggacagcatcaccgtgggcatggtgaggcaccagggcaagatcatgtacgtgggagatgtgagaagcgtgacccagaaacacatccaggagtggggccccttcgacctggtgatcggcggcagcccctgcaacgacctgagcatcgtgaatccagccagaaagggcctgtacgagggcactggcagactgtttttcgagttctacagactgctgcacgatgccagacctaaagagggagatgacaggcctttcttctggctgttcgagaacgtggtggccatgggcgtgagtgataagagagatatcagcagattcctggaatctaaccccgtcatgatcgacgccaaggaggtgtccgccgcccaccgggccagatacttctggggaaatctgcctggcatgaacagacctcttgcttctaccgtgaacgacaagctggaactgcaggagtgcctggaacacggccggatcgccaaattctccaaggtgagaacaatcaccacaagaagcaacagcattaagcagggaaaggaccaacatttccccgttttcatgaacgagaaggaggatatcctgtggtgcaccgagatggaaagagtgtttggctttccagtgcactacaccgacgtttctaatatgagcagactggccagacaaagactgctgggcagaagctggagcgtgcctgtgatccggcacctgtttgcccctctgaaggaatatttcgcctgtgtgtcttctggcaactctaatgctaacagcagaggacctagcttcagcagcggactggttccactgagcctgagaggcagccatatgggacctatggaaatctacaagaccgtgtccgcttggaagcgccagcccgtgcgggtgctcagcctgtttagaaacatcgacaaggtgctgaaaagcctgggattcctggaatccggatctggcagcggcggcggcaccctgaagtacgtggaagatgtgacaaacgtggttaggcgggacgtcgagaagtggggcccttttgacctggtgtacggctccacccagcccctgggctccagctgtgaccggtgccccggctggtacatgttccagttccacagaatactgcagtacgccctgcctagacaggagagccagcggcctttcttctggatcttcatggacaacctgcttctgaccgaagatgatcaggagacaacaaccagattcctgcagaccgaagccgtgaccctgcaagacgtgcggggccgggactaccagaacgctatgagagtgtggtccaacatccccggcctgaagagcaagcacgcccccctgacccctaaagaagaagagtacctgcaggcccaagtgcggagcagaagcaagctggacgcccctaaggtggatctgctggtgaagaactgtctgctgcctctcagagagtactttaaatacttcagccagaacagcctccctctgggaggacctagcagcggcgccccacctccaagcggaggctctccagctggcagccctaccagcacagaggaaggcacaagcgagagcgccacacctgagagcggccctggcacctccaccgagcccagcgagggctctgcccctggcagccccgccggaagccccacctctacagaagaaggcaccagcacagagccttctgaaggctctgcccctggaacatccaccgagcctagcgagaagcggactgccgatggatctgagtttgagagccctaagaaaaaaagaaaggttggggtacccgccgctatggctgagaggcccttccagtgtcgaatctgcatgcgtaacttcagtcgctccgaccacctgtccgagcacatccgcacccacaccggcgagaagccttttgcctgtgacatttgtgggaggaaatttgccgcccgctccacccgcaccaaccataccaagatacacacgggcagccaaaagcccttccagtgtcgaatctgcatgcgtaacttcagtcgctccgacgacctgacccgccacatccgcacccacaccggcgagaagccttttgcctgtgacatttgtgggaggaaatttgcccagtcctccgacctgcgccgccataccaagatacacacgggatctcagaagcccttccagtgtcgaatctgcatgcgtaacttcagtcagtccggctccctgacccgccacatccgcacccacaccggcgagaagccttttgcctgtgacatttgtgggaggaaatttgccgaccgctcccacctggcccgccataccaagatacacctgcgccaaaaagatgcggcccggggatccaagaggaccgccgacggcagcgagttcgagcccaagaaaaagcggaaggtgtccggctctgaaacccctggcacaagcgagtctgctacacctgagtccagaaccctggtcaccttcaaagacgtgttcgtggacttcaccagagaagaatggaagctgctggataccgctcagcagatcgtgtacagaaacgtgatgctggaaaactacaagaatctggtgtccctgggctaccagctgaccaagcctgacgtgatcctgagactggaaaagggcgaggaacccgctacaaacttcagcctgctgaaacaggccggcgacgtcgaggaaaatcctggccccagcgagctgattaaggaaaacatgcacatgaagctgtatatggaaggcaccgtggacaaccaccatttcaagtgcaccagcgagggcgaaggcaagccctacgagggaacacagaccatgcggatcaaggtggtggaaggcggccctctgcccttcgccttcgacatcctcgccacctctttcctgtacggcagtaagacctttatcaaccacacccagggcatccccgatttcttcaagcagagcttccccgagggatttacctgggagagagtgaccacctacgaggacggcggcgtgctgacagccacccaggacaccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 314 - DNA, 6318 bp, synthetic construct
  misc_feature 1..6318: note = synthetic sequence for use in compositions and/or methods
  source 1..6318: mol_type = other DNA
atgaagcggaccgccgacggctctgaattcgagagccctaagaagaaaagaaaggtggccagaacaaagcagaccgcccggaagagcaccggctccggcggatctagcggctctgaaacccctggcaccagcgagagcgccacacccgagagcagcggcggcagcgcacgcacaaagcaaacggctagaaagtcaaccggatctggaggatctagcggaggatcctctggcagcgagacaccaggaacaagcgagtcagcaacaccagagagcagtggcggctccagtggcggatctggacctatggaaatctacaagaccgtgtccgcttggaagcgccagcccgtgcgggtgctcagcctgtttagaaacatcgacaaggtgctgaaaagcctgggattcctggaatccggatctggcagcggcggcggcaccctgaagtacgtggaagatgtgacaaacgtggttaggcgggacgtcgagaagtggggcccttttgacctggtgtacggctccacccagcccctgggctccagctgtgaccggtgccccggctggtacatgttccagttccacagaatactgcagtacgccctgcctagacaggagagccagcggcctttcttctggatcttcatggacaacctgcttctgaccgaagatgatcaggagacaacaaccagattcctgcagaccgaagccgtgaccctgcaagacgtgcggggccgggactaccagaacgctatgagagtgtggtccaacatccccggcctgaagagcaagcacgcccccctgacccctaaagaagaagagtacctgcaggcccaggtccggtcccggagcaagctggacgcccctaaggtggacctgctggtgaagaactgcctgctgcctctgcgggaatacttcaagtacttctctcagaacagcctgcccctgggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtgtccggctctgaaacccctggaacctccgagagcgccacacctgaaagcagaaccctggtgaccttcaaggacgtgttcgtggacttcacccgcgaggaatggaagctcctggacaccgcccagcaaatcgtgtaccggaacgtgatgctggagaattacaagaacctggtgtctctgggctaccagctgacgaagcctgacgtcatcctgagactggaaaagggagaggagcctgccacaaatttcagcctgctgaagcaggccggcgacgtggaagagaatcctggccccagcgagctgatcaaagagaacatgcacatgaagctgtacatggaaggcaccgtggacaaccatcacttcaagtgcaccagcgagggcgagggcaagccctacgagggcacacagaccatgagaatcaaggtggtggaaggaggcccactgcccttcgccttcgacatcctggccaccagctttctgtacggctcaaagaccttcatcaaccacacccagggcatccctgatttcttcaagcagagcttccctgagggatttacctgggagagagtgacaacttatgaagatggcggagtgctgaccgccacacaagataccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 315 - DNA, 6084 bp, synthetic construct
  misc_feature 1..6084: note = synthetic sequence for use in compositions and/or methods
  source 1..6084: mol_type = other DNA
atgaagcggaccgccgacggctctgaattcgagagccctaagaagaaaagaaaggtggccagaacaaagcagaccgcccggaagagcaccggctccggcggatctagcggctctgaaacccctggcaccagcgagagcgccacacccgagagcagcggcggcagcgcacgcacaaagcaaacggctagaaagtcaaccggatctggaggatctagcggaggatcctctggcagcgagacaccaggaacaagcgagtcagcaacaccagagagcagtggcggctccagtggcggatctggacctatggaaatctacaagaccgtgtccgcttggaagcgccagcccgtgcgggtgctcagcctgtttagaaacatcgacaaggtgctgaaaagcctgggattcctggaatccggatctggcagcggcggcggcaccctgaagtacgtggaagatgtgacaaacgtggttaggcgggacgtcgagaagtggggcccttttgacctggtgtacggctccacccagcccctgggctccagctgtgaccggtgccccggctggtacatgttccagttccacagaatactgcagtacgccctgcctagacaggagagccagcggcctttcttctggatcttcatggacaacctgcttctgaccgaagatgatcaggagacaacaaccagattcctgcagaccgaagccgtgaccctgcaagacgtgcggggccgggactaccagaacgctatgagagtgtggtccaacatccccggcctgaagagcaagcacgcccccctgacccctaaagaagaagagtacctgcaggcccaggtccggtcccggagcaagctggacgcccctaaggtggacctgctggtgaagaactgcctgctgcctctgcgggaatacttcaagtacttctctcagaacagcctgcccctgggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtggccacaaatttcagcctgctgaagcaggccggcgacgtggaagagaatcctggccccagcgagctgatcaaagagaacatgcacatgaagctgtacatggaaggcaccgtggacaaccatcacttcaagtgcaccagcgagggcgagggcaagccctacgagggcacacagaccatgagaatcaaggtggtggaaggaggcccactgcccttcgccttcgacatcctggccaccagctttctgtacggctcaaagaccttcatcaaccacacccagggcatccctgatttcttcaagcagagcttccctgagggatttacctgggagagagtgacaacttatgaagatggcggagtgctgaccgccacacaagataccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 316 - DNA, 6264 bp, synthetic construct
  misc_feature 1..6264: note = synthetic sequence for use in compositions and/or methods
  source 1..6264: mol_type = other DNA
atggccagaacaaagcagaccgcccggaagagcaccggcggcggaagcaagcggaccgccgacggctctgaattcgagagccctaagaagaaaagaaaggtgggcggctccgcacgcacaaagcaaacggctagaaagtcaaccggatctggaggatctagcggaggatcctctggcagcgagacaccaggaacaagcgagtcagcaacaccagagagcagtggcggctccagtggcggatctggacctatggaaatctacaagaccgtgtccgcttggaagcgccagcccgtgcgggtgctcagcctgtttagaaacatcgacaaggtgctgaaaagcctgggattcctggaatccggatctggcagcggcggcggcaccctgaagtacgtggaagatgtgacaaacgtggttaggcgggacgtcgagaagtggggcccttttgacctggtgtacggctccacccagcccctgggctccagctgtgaccggtgccccggctggtacatgttccagttccacagaatactgcagtacgccctgcctagacaggagagccagcggcctttcttctggatcttcatggacaacctgcttctgaccgaagatgatcaggagacaacaaccagattcctgcagaccgaagccgtgaccctgcaagacgtgcggggccgggactaccagaacgctatgagagtgtggtccaacatccccggcctgaagagcaagcacgcccccctgacccctaaagaagaagagtacctgcaggcccaggtccggtcccggagcaagctggacgcccctaaggtggacctgctggtgaagaactgcctgctgcctctgcgggaatacttcaagtacttctctcagaacagcctgcccctgggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtgtccggctctgaaacccctggaacctccgagagcgccacacctgaaagcagaaccctggtgaccttcaaggacgtgttcgtggacttcacccgcgaggaatggaagctcctggacaccgcccagcaaatcgtgtaccggaacgtgatgctggagaattacaagaacctggtgtctctgggctaccagctgacgaagcctgacgtcatcctgagactggaaaagggagaggagcctgccacaaatttcagcctgctgaagcaggccggcgacgtggaagagaatcctggccccagcgagctgatcaaagagaacatgcacatgaagctgtacatggaaggcaccgtggacaaccatcacttcaagtgcaccagcgagggcgagggcaagccctacgagggcacacagaccatgagaatcaaggtggtggaaggaggcccactgcccttcgccttcgacatcctggccaccagctttctgtacggctcaaagaccttcatcaaccacacccagggcatccctgatttcttcaagcagagcttccctgagggatttacctgggagagagtgacaacttatgaagatggcggagtgctgaccgccacacaagataccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 317 - DNA, 6030 bp, synthetic construct
  misc_feature 1..6030: note = synthetic sequence for use in compositions and/or methods
  source 1..6030: mol_type = other DNA
atggccagaacaaagcagaccgcccggaagagcaccggcggcggaagcaagcggaccgccgacggctctgaattcgagagccctaagaagaaaagaaaggtgggcggctccgcacgcacaaagcaaacggctagaaagtcaaccggatctggaggatctagcggaggatcctctggcagcgagacaccaggaacaagcgagtcagcaacaccagagagcagtggcggctccagtggcggatctggacctatggaaatctacaagaccgtgtccgcttggaagcgccagcccgtgcgggtgctcagcctgtttagaaacatcgacaaggtgctgaaaagcctgggattcctggaatccggatctggcagcggcggcggcaccctgaagtacgtggaagatgtgacaaacgtggttaggcgggacgtcgagaagtggggcccttttgacctggtgtacggctccacccagcccctgggctccagctgtgaccggtgccccggctggtacatgttccagttccacagaatactgcagtacgccctgcctagacaggagagccagcggcctttcttctggatcttcatggacaacctgcttctgaccgaagatgatcaggagacaacaaccagattcctgcagaccgaagccgtgaccctgcaagacgtgcggggccgggactaccagaacgctatgagagtgtggtccaacatccccggcctgaagagcaagcacgcccccctgacccctaaagaagaagagtacctgcaggcccaggtccggtcccggagcaagctggacgcccctaaggtggacctgctggtgaagaactgcctgctgcctctgcgggaatacttcaagtacttctctcagaacagcctgcccctgggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtggccacaaatttcagcctgctgaagcaggccggcgacgtggaagagaatcctggccccagcgagctgatcaaagagaacatgcacatgaagctgtacatggaaggcaccgtggacaaccatcacttcaagtgcaccagcgagggcgagggcaagccctacgagggcacacagaccatgagaatcaaggtggtggaaggaggcccactgcccttcgccttcgacatcctggccaccagctttctgtacggctcaaagaccttcatcaaccacacccagggcatccctgatttcttcaagcagagcttccctgagggatttacctgggagagagtgacaacttatgaagatggcggagtgctgaccgccacacaagataccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 318 - DNA, 6156 bp, synthetic construct
  misc_feature 1..6156: note = synthetic sequence for use in compositions and/or methods
  source 1..6156: mol_type = other DNA
atggccagaacaaagcagaccgcccggaagagcaccggctctggaggatctagcggaggatcctctggcagcgagacaccaggaacaagcgagtcagcaacaccagagagcagtggcggctccagtggcggatctggacctatggaaatctacaagaccgtgtccgcttggaagcgccagcccgtgcgggtgctcagcctgtttagaaacatcgacaaggtgctgaaaagcctgggattcctggaatccggatctggcagcggcggcggcaccctgaagtacgtggaagatgtgacaaacgtggttaggcgggacgtcgagaagtggggcccttttgacctggtgtacggctccacccagcccctgggctccagctgtgaccggtgccccggctggtacatgttccagttccacagaatactgcagtacgccctgcctagacaggagagccagcggcctttcttctggatcttcatggacaacctgcttctgaccgaagatgatcaggagacaacaaccagattcctgcagaccgaagccgtgaccctgcaagacgtgcggggccgggactaccagaacgctatgagagtgtggtccaacatccccggcctgaagagcaagcacgcccccctgacccctaaagaagaagagtacctgcaggcccaggtccggtcccggagcaagctggacgcccctaaggtggacctgctggtgaagaactgcctgctgcctctgcgggaatacttcaagtacttctctcagaacagcctgcccctgggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtgtccggctctgaaacccctggaacctccgagagcgccacacctgaaagcagaaccctggtgaccttcaaggacgtgttcgtggacttcacccgcgaggaatggaagctcctggacaccgcccagcaaatcgtgtaccggaacgtgatgctggagaattacaagaacctggtgtctctgggctaccagctgacgaagcctgacgtcatcctgagactggaaaagggagaggagcctgccacaaatttcagcctgctgaagcaggccggcgacgtggaagagaatcctggccccagcgagctgatcaaagagaacatgcacatgaagctgtacatggaaggcaccgtggacaaccatcacttcaagtgcaccagcgagggcgagggcaagccctacgagggcacacagaccatgagaatcaaggtggtggaaggaggcccactgcccttcgccttcgacatcctggccaccagctttctgtacggctcaaagaccttcatcaaccacacccagggcatccctgatttcttcaagcagagcttccctgagggatttacctgggagagagtgacaacttatgaagatggcggagtgctgaccgccacacaagataccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 319 - DNA, 5922 bp, synthetic construct
  misc_feature 1..5922: note = synthetic sequence for use in compositions and/or methods
  source 1..5922: mol_type = other DNA
atggccagaacaaagcagaccgcccggaagagcaccggctctggaggatctagcggaggatcctctggcagcgagacaccaggaacaagcgagtcagcaacaccagagagcagtggcggctccagtggcggatctggacctatggaaatctacaagaccgtgtccgcttggaagcgccagcccgtgcgggtgctcagcctgtttagaaacatcgacaaggtgctgaaaagcctgggattcctggaatccggatctggcagcggcggcggcaccctgaagtacgtggaagatgtgacaaacgtggttaggcgggacgtcgagaagtggggcccttttgacctggtgtacggctccacccagcccctgggctccagctgtgaccggtgccccggctggtacatgttccagttccacagaatactgcagtacgccctgcctagacaggagagccagcggcctttcttctggatcttcatggacaacctgcttctgaccgaagatgatcaggagacaacaaccagattcctgcagaccgaagccgtgaccctgcaagacgtgcggggccgggactaccagaacgctatgagagtgtggtccaacatccccggcctgaagagcaagcacgcccccctgacccctaaagaagaagagtacctgcaggcccaggtccggtcccggagcaagctggacgcccctaaggtggacctgctggtgaagaactgcctgctgcctctgcgggaatacttcaagtacttctctcagaacagcctgcccctgggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtggccacaaatttcagcctgctgaagcaggccggcgacgtggaagagaatcctggccccagcgagctgatcaaagagaacatgcacatgaagctgtacatggaaggcaccgtggacaaccatcacttcaagtgcaccagcgagggcgagggcaagccctacgagggcacacagaccatgagaatcaaggtggtggaaggaggcccactgcccttcgccttcgacatcctggccaccagctttctgtacggctcaaagaccttcatcaaccacacccagggcatccctgatttcttcaagcagagcttccctgagggatttacctgggagagagtgacaacttatgaagatggcggagtgctgaccgccacacaagataccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 320 - DNA, 6234 bp, synthetic construct
  misc_feature 1..6234: note = synthetic sequence for use in compositions and/or methods
  source 1..6234: mol_type = other DNA
atgaagcggaccgccgacggctctgaattcgagagccctaagaagaaaagaaaggtggctcggaccaagcagaccgccagaaagagcaccggcggcggacctagcagcggcgcccctcctccatctggcggatctcctgccggcagccccacatccaccgaggaaggcacaagcgagtccgccacccctgaaagcggccccggcaccagcacaggacctatggaaatctacaagaccgtgtccgcttggaagcgccagcccgtgcgggtgctcagcctgtttagaaacatcgacaaggtgctgaaaagcctgggattcctggaatccggatctggcagcggcggcggcaccctgaagtacgtggaagatgtgacaaacgtggttaggcgggacgtcgagaagtggggcccttttgacctggtgtacggctccacccagcccctgggctccagctgtgaccggtgccccggctggtacatgttccagttccacagaatactgcagtacgccctgcctagacaggagagccagcggcctttcttctggatcttcatggacaacctgcttctgaccgaagatgatcaggagacaacaaccagattcctgcagaccgaagccgtgaccctgcaagacgtgcggggccgggactaccagaacgctatgagagtgtggtccaacatccccggcctgaagagcaagcacgcccccctgacccctaaagaagaagagtacctgcaggcccaggtccggtcccggagcaagctggacgcccctaaggtggacctgctggtgaagaactgcctgctgcctctgcgggaatacttcaagtacttctctcagaacagcctgcccctgggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtgtccggctctgaaacccctggaacctccgagagcgccacacctgaaagcagaaccctggtgaccttcaaggacgtgttcgtggacttcacccgcgaggaatggaagctcctggacaccgcccagcaaatcgtgtaccggaacgtgatgctggagaattacaagaacctggtgtctctgggctaccagctgacgaagcctgacgtcatcctgagactggaaaagggagaggagcctgccacaaatttcagcctgctgaagcaggccggcgacgtggaagagaatcctggccccagcgagctgatcaaagagaacatgcacatgaagctgtacatggaaggcaccgtggacaaccatcacttcaagtgcaccagcgagggcgagggcaagccctacgagggcacacagaccatgagaatcaaggtggtggaaggaggcccactgcccttcgccttcgacatcctggccaccagctttctgtacggctcaaagaccttcatcaaccacacccagggcatccctgatttcttcaagcagagcttccctgagggatttacctgggagagagtgacaacttatgaagatggcggagtgctgaccgccacacaagataccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 321 - DNA, 6000 bp, synthetic construct
  misc_feature 1..6000: note = synthetic sequence for use in compositions and/or methods
  source 1..6000: mol_type = other DNA
atgaagcggaccgccgacggctctgaattcgagagccctaagaagaaaagaaaggtggctcggaccaagcagaccgccagaaagagcaccggcggcggacctagcagcggcgcccctcctccatctggcggatctcctgccggcagccccacatccaccgaggaaggcacaagcgagtccgccacccctgaaagcggccccggcaccagcacaggacctatggaaatctacaagaccgtgtccgcttggaagcgccagcccgtgcgggtgctcagcctgtttagaaacatcgacaaggtgctgaaaagcctgggattcctggaatccggatctggcagcggcggcggcaccctgaagtacgtggaagatgtgacaaacgtggttaggcgggacgtcgagaagtggggcccttttgacctggtgtacggctccacccagcccctgggctccagctgtgaccggtgccccggctggtacatgttccagttccacagaatactgcagtacgccctgcctagacaggagagccagcggcctttcttctggatcttcatggacaacctgcttctgaccgaagatgatcaggagacaacaaccagattcctgcagaccgaagccgtgaccctgcaagacgtgcggggccgggactaccagaacgctatgagagtgtggtccaacatccccggcctgaagagcaagcacgcccccctgacccctaaagaagaagagtacctgcaggcccaggtccggtcccggagcaagctggacgcccctaaggtggacctgctggtgaagaactgcctgctgcctctgcgggaatacttcaagtacttctctcagaacagcctgcccctgggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtggccacaaatttcagcctgctgaagcaggccggcgacgtggaagagaatcctggccccagcgagctgatcaaagagaacatgcacatgaagctgtacatggaaggcaccgtggacaaccatcacttcaagtgcaccagcgagggcgagggcaagccctacgagggcacacagaccatgagaatcaaggtggtggaaggaggcccactgcccttcgccttcgacatcctggccaccagctttctgtacggctcaaagaccttcatcaaccacacccagggcatccctgatttcttcaagcagagcttccctgagggatttacctgggagagagtgacaacttatgaagatggcggagtgctgaccgccacacaagataccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 322 - DNA, 6180 bp, synthetic construct
  misc_feature 1..6180: note = synthetic sequence for use in compositions and/or methods
  source 1..6180: mol_type = other DNA
atgcagaaggctagcaagggcaccgccagaaccacccggggcggacctagcagcggcgcccctcctccatctggcggatctcctgccggcagccccacatccaccgaggaaggcacaagcgagtccgccacccctgaaagcggccccggcaccagcacaggacctatggaaatctacaagaccgtgtccgcttggaagcgccagcccgtgcgggtgctcagcctgtttagaaacatcgacaaggtgctgaaaagcctgggattcctggaatccggatctggcagcggcggcggcaccctgaagtacgtggaagatgtgacaaacgtggttaggcgggacgtcgagaagtggggcccttttgacctggtgtacggctccacccagcccctgggctccagctgtgaccggtgccccggctggtacatgttccagttccacagaatactgcagtacgccctgcctagacaggagagccagcggcctttcttctggatcttcatggacaacctgcttctgaccgaagatgatcaggagacaacaaccagattcctgcagaccgaagccgtgaccctgcaagacgtgcggggccgggactaccagaacgctatgagagtgtggtccaacatccccggcctgaagagcaagcacgcccccctgacccctaaagaagaagagtacctgcaggcccaggtccggtcccggagcaagctggacgcccctaaggtggacctgctggtgaagaactgcctgctgcctctgcgggaatacttcaagtacttctctcagaacagcctgcccctgggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtgtccggctctgaaacccctggaacctccgagagcgccacacctgaaagcagaaccctggtgaccttcaaggacgtgttcgtggacttcacccgcgaggaatggaagctcctggacaccgcccagcaaatcgtgtaccggaacgtgatgctggagaattacaagaacctggtgtctctgggctaccagctgacgaagcctgacgtcatcctgagactggaaaagggagaggagcctgccacaaatttcagcctgctgaagcaggccggcgacgtggaagagaatcctggccccagcgagctgatcaaagagaacatgcacatgaagctgtacatggaaggcaccgtggacaaccatcacttcaagtgcaccagcgagggcgagggcaagccctacgagggcacacagaccatgagaatcaaggtggtggaaggaggcccactgcccttcgccttcgacatcctggccaccagctttctgtacggctcaaagaccttcatcaaccacacccagggcatccctgatttcttcaagcagagcttccctgagggatttacctgggagagagtgacaacttatgaagatggcggagtgctgaccgccacacaagataccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 323 - DNA, 5946 bp, synthetic construct
  misc_feature 1..5946: note = synthetic sequence for use in compositions and/or methods
  source 1..5946: mol_type = other DNA
atgcagaaggctagcaagggcaccgccagaaccacccggggcggacctagcagcggcgcccctcctccatctggcggatctcctgccggcagccccacatccaccgaggaaggcacaagcgagtccgccacccctgaaagcggccccggcaccagcacaggacctatggaaatctacaagaccgtgtccgcttggaagcgccagcccgtgcgggtgctcagcctgtttagaaacatcgacaaggtgctgaaaagcctgggattcctggaatccggatctggcagcggcggcggcaccctgaagtacgtggaagatgtgacaaacgtggttaggcgggacgtcgagaagtggggcccttttgacctggtgtacggctccacccagcccctgggctccagctgtgaccggtgccccggctggtacatgttccagttccacagaatactgcagtacgccctgcctagacaggagagccagcggcctttcttctggatcttcatggacaacctgcttctgaccgaagatgatcaggagacaacaaccagattcctgcagaccgaagccgtgaccctgcaagacgtgcggggccgggactaccagaacgctatgagagtgtggtccaacatccccggcctgaagagcaagcacgcccccctgacccctaaagaagaagagtacctgcaggcccaggtccggtcccggagcaagctggacgcccctaaggtggacctgctggtgaagaactgcctgctgcctctgcgggaatacttcaagtacttctctcagaacagcctgcccctgggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtggccacaaatttcagcctgctgaagcaggccggcgacgtggaagagaatcctggccccagcgagctgatcaaagagaacatgcacatgaagctgtacatggaaggcaccgtggacaaccatcacttcaagtgcaccagcgagggcgagggcaagccctacgagggcacacagaccatgagaatcaaggtggtggaaggaggcccactgcccttcgccttcgacatcctggccaccagctttctgtacggctcaaagaccttcatcaaccacacccagggcatccctgatttcttcaagcagagcttccctgagggatttacctgggagagagtgacaacttatgaagatggcggagtgctgaccgccacacaagataccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 324 - DNA, 6180 bp, synthetic construct
  misc_feature 1..6180: note = synthetic sequence for use in compositions and/or methods
  source 1..6180: mol_type = other DNA
atggctcggaccgcccagaccgccagaaagagcaccggcggcggacctagcagcggcgcccctcctccatctggcggatctcctgccggcagccccacatccaccgaggaaggcacaagcgagtccgccacccctgaaagcggccccggcaccagcacaggacctatggaaatctacaagaccgtgtccgcttggaagcgccagcccgtgcgggtgctcagcctgtttagaaacatcgacaaggtgctgaaaagcctgggattcctggaatccggatctggcagcggcggcggcaccctgaagtacgtggaagatgtgacaaacgtggttaggcgggacgtcgagaagtggggcccttttgacctggtgtacggctccacccagcccctgggctccagctgtgaccggtgccccggctggtacatgttccagttccacagaatactgcagtacgccctgcctagacaggagagccagcggcctttcttctggatcttcatggacaacctgcttctgaccgaagatgatcaggagacaacaaccagattcctgcagaccgaagccgtgaccctgcaagacgtgcggggccgggactaccagaacgctatgagagtgtggtccaacatccccggcctgaagagcaagcacgcccccctgacccctaaagaagaagagtacctgcaggcccaggtccggtcccggagcaagctggacgcccctaaggtggacctgctggtgaagaactgcctgctgcctctgcgggaatacttcaagtacttctctcagaacagcctgcccctgggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtgtccggctctgaaacccctggaacctccgagagcgccacacctgaaagcagaaccctggtgaccttcaaggacgtgttcgtggacttcacccgcgaggaatggaagctcctggacaccgcccagcaaatcgtgtaccggaacgtgatgctggagaattacaagaacctggtgtctctgggctaccagctgacgaagcctgacgtcatcctgagactggaaaagggagaggagcctgccacaaatttcagcctgctgaagcaggccggcgacgtggaagagaatcctggccccagcgagctgatcaaagagaacatgcacatgaagctgtacatggaaggcaccgtggacaaccatcacttcaagtgcaccagcgagggcgagggcaagccctacgagggcacacagaccatgagaatcaaggtggtggaaggaggcccactgcccttcgccttcgacatcctggccaccagctttctgtacggctcaaagaccttcatcaaccacacccagggcatccctgatttcttcaagcagagcttccctgagggatttacctgggagagagtgacaacttatgaagatggcggagtgctgaccgccacacaagataccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 325 - DNA, 5946 bp, synthetic construct
  misc_feature 1..5946: note = synthetic sequence for use in compositions and/or methods
  source 1..5946: mol_type = other DNA
atggctcggaccgcccagaccgccagaaagagcaccggcggcggacctagcagcggcgcccctcctccatctggcggatctcctgccggcagccccacatccaccgaggaaggcacaagcgagtccgccacccctgaaagcggccccggcaccagcacaggacctatggaaatctacaagaccgtgtccgcttggaagcgccagcccgtgcgggtgctcagcctgtttagaaacatcgacaaggtgctgaaaagcctgggattcctggaatccggatctggcagcggcggcggcaccctgaagtacgtggaagatgtgacaaacgtggttaggcgggacgtcgagaagtggggcccttttgacctggtgtacggctccacccagcccctgggctccagctgtgaccggtgccccggctggtacatgttccagttccacagaatactgcagtacgccctgcctagacaggagagccagcggcctttcttctggatcttcatggacaacctgcttctgaccgaagatgatcaggagacaacaaccagattcctgcagaccgaagccgtgaccctgcaagacgtgcggggccgggactaccagaacgctatgagagtgtggtccaacatccccggcctgaagagcaagcacgcccccctgacccctaaagaagaagagtacctgcaggcccaggtccggtcccggagcaagctggacgcccctaaggtggacctgctggtgaagaactgcctgctgcctctgcgggaatacttcaagtacttctctcagaacagcctgcccctgggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtggccacaaatttcagcctgctgaagcaggccggcgacgtggaagagaatcctggccccagcgagctgatcaaagagaacatgcacatgaagctgtacatggaaggcaccgtggacaaccatcacttcaagtgcaccagcgagggcgagggcaagccctacgagggcacacagaccatgagaatcaaggtggtggaaggaggcccactgcccttcgccttcgacatcctggccaccagctttctgtacggctcaaagaccttcatcaaccacacccagggcatccctgatttcttcaagcagagcttccctgagggatttacctgggagagagtgacaacttatgaagatggcggagtgctgaccgccacacaagataccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 326 - DNA, 1656 bp, synthetic construct
  misc_feature 1..1656: note = synthetic sequence for use in compositions and/or methods
  source 1..1656: mol_type = other DNA
atgaagcggactgccgatggatctgagtttgagagccctaagaaaaaaagaaaggttggggtacccgccgctatggctgagaggcccttccagtgtcgaatctgcatgcgtaacttcagtcgctccgaccacctgtccgagcacatccgcacccacaccggcgagaagccttttgcctgtgacatttgtgggaggaaatttgccgcccgctccacccgcaccaaccataccaagatacacacgggcagccaaaagcccttccagtgtcgaatctgcatgcgtaacttcagtcgctccgacgacctgacccgccacatccgcacccacaccggcgagaagccttttgcctgtgacatttgtgggaggaaatttgcccagtcctccgacctgcgccgccataccaagatacacacgggatctcagaagcccttccagtgtcgaatctgcatgcgtaacttcagtcagtccggctccctgacccgccacatccgcacccacaccggcgagaagccttttgcctgtgacatttgtgggaggaaatttgccgaccgctcccacctggcccgccataccaagatacacctgcgccaaaaagatgcggcccggggatccaagaggaccgccgacggcagcgagttcgagcccaagaaaaagcggaaggtgtccggctctgaaacccctggcacaagcgagtctgctacacctgagtccagaaccctggtcaccttcaaagacgtgttcgtggacttcaccagagaagaatggaagctgctggataccgctcagcagatcgtgtacagaaacgtgatgctggaaaactacaagaatctggtgtccctgggctaccagctgaccaagcctgacgtgatcctgagactggaaaagggcgaggaacccgctacaaacttcagcctgctgaaacaggccggcgacgtcgaggaaaatcctggccccagcgagctgattaaggaaaacatgcacatgaagctgtatatggaaggcaccgtggacaaccaccatttcaagtgcaccagcgagggcgaaggcaagccctacgagggaacacagaccatgcggatcaaggtggtggaaggcggccctctgcccttcgccttcgacatcctcgccacctctttcctgtacggcagtaagacctttatcaaccacacccagggcatccccgatttcttcaagcagagcttccccgagggatttacctgggagagagtgaccacctacgaggacggcggcgtgctgacagccacccaggacaccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 327 - DNA, 5928 bp, synthetic construct
  misc_feature 1..5928: note = synthetic sequence for use in compositions and/or methods
  source 1..5928: mol_type = other DNA
atggctcggaccaagcagaccgccagaaagagcaccggcggcggacctagcagcggcgcccctcctccatctggcggatctcctgccggcagccccacatccaccgaggaaggcacaagcgagtccgccacccctgaaagcggacctatggaaatctacaagaccgtgtccgcttggaagcgccagcccgtgcgggtgctcagcctgtttagaaacatcgacaaggtgctgaaaagcctgggattcctggaatccggatctggcagcggcggcggcaccctgaagtacgtggaagatgtgacaaacgtggttaggcgggacgtcgagaagtggggcccttttgacctggtgtacggctccacccagcccctgggctccagctgtgaccggtgccccggctggtacatgttccagttccacagaatactgcagtacgccctgcctagacaggagagccagcggcctttcttctggatcttcatggacaacctgcttctgaccgaagatgatcaggagacaacaaccagattcctgcagaccgaagccgtgaccctgcaagacgtgcggggccgggactaccagaacgctatgagagtgtggtccaacatccccggcctgaagagcaagcacgcccccctgacccctaaagaagaagagtacctgcaggcccaggtccggtcccggagcaagctggacgcccctaaggtggacctgctggtgaagaactgcctgctgcctctgcgggaatacttcaagtacttctctcagaacagcctgcccctgggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtggccacaaatttcagcctgctgaagcaggccggcgacgtggaagagaatcctggccccagcgagctgatcaaagagaacatgcacatgaagctgtacatggaaggcaccgtggacaaccatcacttcaagtgcaccagcgagggcgagggcaagccctacgagggcacacagaccatgagaatcaaggtggtggaaggaggcccactgcccttcgccttcgacatcctggccaccagctttctgtacggctcaaagaccttcatcaaccacacccagggcatccctgatttcttcaagcagagcttccctgagggatttacctgggagagagtgacaacttatgaagatggcggagtgctgaccgccacacaagataccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 328 - DNA, 5934 bp, synthetic construct
  misc_feature 1..5934: note = synthetic sequence for use in compositions and/or methods
  source 1..5934: mol_type = other DNA
atggctcggaccaagcagaccgccagaaagagcaccggcggcggacctagcagcggcgcccctcctccatctggcggatctcctgccggcagccccacatccaccgaggaaggcacaagcgagtccgccacccctgaaagcggccccggacctatggaaatctacaagaccgtgtccgcttggaagcgccagcccgtgcgggtgctcagcctgtttagaaacatcgacaaggtgctgaaaagcctgggattcctggaatccggatctggcagcggcggcggcaccctgaagtacgtggaagatgtgacaaacgtggttaggcgggacgtcgagaagtggggcccttttgacctggtgtacggctccacccagcccctgggctccagctgtgaccggtgccccggctggtacatgttccagttccacagaatactgcagtacgccctgcctagacaggagagccagcggcctttcttctggatcttcatggacaacctgcttctgaccgaagatgatcaggagacaacaaccagattcctgcagaccgaagccgtgaccctgcaagacgtgcggggccgggactaccagaacgctatgagagtgtggtccaacatccccggcctgaagagcaagcacgcccccctgacccctaaagaagaagagtacctgcaggcccaggtccggtcccggagcaagctggacgcccctaaggtggacctgctggtgaagaactgcctgctgcctctgcgggaatacttcaagtacttctctcagaacagcctgcccctgggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtggccacaaatttcagcctgctgaagcaggccggcgacgtggaagagaatcctggccccagcgagctgatcaaagagaacatgcacatgaagctgtacatggaaggcaccgtggacaaccatcacttcaagtgcaccagcgagggcgagggcaagccctacgagggcacacagaccatgagaatcaaggtggtggaaggaggcccactgcccttcgccttcgacatcctggccaccagctttctgtacggctcaaagaccttcatcaaccacacccagggcatccctgatttcttcaagcagagcttccctgagggatttacctgggagagagtgacaacttatgaagatggcggagtgctgaccgccacacaagataccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 329 - DNA, 5940 bp, synthetic construct
  misc_feature 1..5940: note = synthetic sequence for use in compositions and/or methods
  source 1..5940: mol_type = other DNA
atggctcggaccaagcagaccgccagaaagagcaccggcggcggacctagcagcggcgcccctcctccatctggcggatctcctgccggcagccccacatccaccgaggaaggcacaagcgagtccgccacccctgaaagcggccccggcaccggacctatggaaatctacaagaccgtgtccgcttggaagcgccagcccgtgcgggtgctcagcctgtttagaaacatcgacaaggtgctgaaaagcctgggattcctggaatccggatctggcagcggcggcggcaccctgaagtacgtggaagatgtgacaaacgtggttaggcgggacgtcgagaagtggggcccttttgacctggtgtacggctccacccagcccctgggctccagctgtgaccggtgccccggctggtacatgttccagttccacagaatactgcagtacgccctgcctagacaggagagccagcggcctttcttctggatcttcatggacaacctgcttctgaccgaagatgatcaggagacaacaaccagattcctgcagaccgaagccgtgaccctgcaagacgtgcggggccgggactaccagaacgctatgagagtgtggtccaacatccccggcctgaagagcaagcacgcccccctgacccctaaagaagaagagtacctgcaggcccaggtccggtcccggagcaagctggacgcccctaaggtggacctgctggtgaagaactgcctgctgcctctgcgggaatacttcaagtacttctctcagaacagcctgcccctgggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtggccacaaatttcagcctgctgaagcaggccggcgacgtggaagagaatcctggccccagcgagctgatcaaagagaacatgcacatgaagctgtacatggaaggcaccgtggacaaccatcacttcaagtgcaccagcgagggcgagggcaagccctacgagggcacacagaccatgagaatcaaggtggtggaaggaggcccactgcccttcgccttcgacatcctggccaccagctttctgtacggctcaaagaccttcatcaaccacacccagggcatccctgatttcttcaagcagagcttccctgagggatttacctgggagagagtgacaacttatgaagatggcggagtgctgaccgccacacaagataccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 330 - DNA, 5946 bp, synthetic construct
  misc_feature 1..5946: note = synthetic sequence for use in compositions and/or methods
  source 1..5946: mol_type = other DNA
atggctcggaccaagcagaccgccagaaagagcaccggcggcggaggaagcagcggcgccccttcaccatctggcggatctcctgccggcagccccacatccaccgaggaaggcacaagcgagtccgccacccctgaaagcggctcaggcggtagcggaggacctatggaaatctacaagaccgtgtccgcttggaagcgccagcccgtgcgggtgctcagcctgtttagaaacatcgacaaggtgctgaaaagcctgggattcctggaatccggatctggcagcggcggcggcaccctgaagtacgtggaagatgtgacaaacgtggttaggcgggacgtcgagaagtggggcccttttgacctggtgtacggctccacccagcccctgggctccagctgtgaccggtgccccggctggtacatgttccagttccacagaatactgcagtacgccctgcctagacaggagagccagcggcctttcttctggatcttcatggacaacctgcttctgaccgaagatgatcaggagacaacaaccagattcctgcagaccgaagccgtgaccctgcaagacgtgcggggccgggactaccagaacgctatgagagtgtggtccaacatccccggcctgaagagcaagcacgcccccctgacccctaaagaagaagagtacctgcaggcccaggtccggtcccggagcaagctggacgcccctaaggtggacctgctggtgaagaactgcctgctgcctctgcgggaatacttcaagtacttctctcagaacagcctgcccctgggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtggccacaaatttcagcctgctgaagcaggccggcgacgtggaagagaatcctggccccagcgagctgatcaaagagaacatgcacatgaagctgtacatggaaggcaccgtggacaaccatcacttcaagtgcaccagcgagggcgagggcaagccctacgagggcacacagaccatgagaatcaaggtggtggaaggaggcccactgcccttcgccttcgacatcctggccaccagctttctgtacggctcaaagaccttcatcaaccacacccagggcatccctgatttcttcaagcagagcttccctgagggatttacctgggagagagtgacaacttatgaagatggcggagtgctgaccgccacacaagataccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 331 - DNA, 5946 bp, synthetic construct
  misc_feature 1..5946: note = synthetic sequence for use in compositions and/or methods
  source 1..5946: mol_type = other DNA
atggctcggaccaagcagaccgccagaaagagcaccggcggcggagcaagctctggcgccggatcaagttctggcggatctgcagccggcagcggatcatccggtgctagtggctcaagcggatccgccagtagcggcagcggctcaggcggtagcggaggacctatggaaatctacaagaccgtgtccgcttggaagcgccagcccgtgcgggtgctcagcctgtttagaaacatcgacaaggtgctgaaaagcctgggattcctggaatccggatctggcagcggcggcggcaccctgaagtacgtggaagatgtgacaaacgtggttaggcgggacgtcgagaagtggggcccttttgacctggtgtacggctccacccagcccctgggctccagctgtgaccggtgccccggctggtacatgttccagttccacagaatactgcagtacgccctgcctagacaggagagccagcggcctttcttctggatcttcatggacaacctgcttctgaccgaagatgatcaggagacaacaaccagattcctgcagaccgaagccgtgaccctgcaagacgtgcggggccgggactaccagaacgctatgagagtgtggtccaacatccccggcctgaagagcaagcacgcccccctgacccctaaagaagaagagtacctgcaggcccaggtccggtcccggagcaagctggacgcccctaaggtggacctgctggtgaagaactgcctgctgcctctgcgggaatacttcaagtacttctctcagaacagcctgcccctgggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtggccacaaatttcagcctgctgaagcaggccggcgacgtggaagagaatcctggccccagcgagctgatcaaagagaacatgcacatgaagctgtacatggaaggcaccgtggacaaccatcacttcaagtgcaccagcgagggcgagggcaagccctacgagggcacacagaccatgagaatcaaggtggtggaaggaggcccactgcccttcgccttcgacatcctggccaccagctttctgtacggctcaaagaccttcatcaaccacacccagggcatccctgatttcttcaagcagagcttccctgagggatttacctgggagagagtgacaacttatgaagatggcggagtgctgaccgccacacaagataccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 332 - DNA, 5952 bp, synthetic construct
  misc_feature 1..5952: note = synthetic sequence for use in compositions and/or methods
  source 1..5952: mol_type = other DNA
atggctcggaccaagcagaccgccagaaagagcaccggcggcggacctagcagcggcgcccctcctccatctggcggatctcctgccggcagccccacatccaccgaggaaggcacaagcgagtccgccacccctgaaagcggccccggcaccagcacaggaggtggacctatggaaatctacaagaccgtgtccgcttggaagcgccagcccgtgcgggtgctcagcctgtttagaaacatcgacaaggtgctgaaaagcctgggattcctggaatccggatctggcagcggcggcggcaccctgaagtacgtggaagatgtgacaaacgtggttaggcgggacgtcgagaagtggggcccttttgacctggtgtacggctccacccagcccctgggctccagctgtgaccggtgccccggctggtacatgttccagttccacagaatactgcagtacgccctgcctagacaggagagccagcggcctttcttctggatcttcatggacaacctgcttctgaccgaagatgatcaggagacaacaaccagattcctgcagaccgaagccgtgaccctgcaagacgtgcggggccgggactaccagaacgctatgagagtgtggtccaacatccccggcctgaagagcaagcacgcccccctgacccctaaagaagaagagtacctgcaggcccaggtccggtcccggagcaagctggacgcccctaaggtggacctgctggtgaagaactgcctgctgcctctgcgggaatacttcaagtacttctctcagaacagcctgcccctgggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtggccacaaatttcagcctgctgaagcaggccggcgacgtggaagagaatcctggccccagcgagctgatcaaagagaacatgcacatgaagctgtacatggaaggcaccgtggacaaccatcacttcaagtgcaccagcgagggcgagggcaagccctacgagggcacacagaccatgagaatcaaggtggtggaaggaggcccactgcccttcgccttcgacatcctggccaccagctttctgtacggctcaaagaccttcatcaaccacacccagggcatccctgatttcttcaagcagagcttccctgagggatttacctgggagagagtgacaacttatgaagatggcggagtgctgaccgccacacaagataccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 333 - DNA, 5958 bp, synthetic construct
  misc_feature 1..5958: note = synthetic sequence for use in compositions and/or methods
  source 1..5958: mol_type = other DNA
atggctcggaccaagcagaccgccagaaagagcaccggcggcggacctagcagcggcgcccctcctccatctggcggatctcctgccggcagccccacatccaccgaggaaggcacaagcgagtccgccacccctgaaagcggccccggcaccagcacaggaggttccggaggacctatggaaatctacaagaccgtgtccgcttggaagcgccagcccgtgcgggtgctcagcctgtttagaaacatcgacaaggtgctgaaaagcctgggattcctggaatccggatctggcagcggcggcggcaccctgaagtacgtggaagatgtgacaaacgtggttaggcgggacgtcgagaagtggggcccttttgacctggtgtacggctccacccagcccctgggctccagctgtgaccggtgccccggctggtacatgttccagttccacagaatactgcagtacgccctgcctagacaggagagccagcggcctttcttctggatcttcatggacaacctgcttctgaccgaagatgatcaggagacaacaaccagattcctgcagaccgaagccgtgaccctgcaagacgtgcggggccgggactaccagaacgctatgagagtgtggtccaacatccccggcctgaagagcaagcacgcccccctgacccctaaagaagaagagtacctgcaggcccaggtccggtcccggagcaagctggacgcccctaaggtggacctgctggtgaagaactgcctgctgcctctgcgggaatacttcaagtacttctctcagaacagcctgcccctgggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtggccacaaatttcagcctgctgaagcaggccggcgacgtggaagagaatcctggccccagcgagctgatcaaagagaacatgcacatgaagctgtacatggaaggcaccgtggacaaccatcacttcaagtgcaccagcgagggcgagggcaagccctacgagggcacacagaccatgagaatcaaggtggtggaaggaggcccactgcccttcgccttcgacatcctggccaccagctttctgtacggctcaaagaccttcatcaaccacacccagggcatccctgatttcttcaagcagagcttccctgagggatttacctgggagagagtgacaacttatgaagatggcggagtgctgaccgccacacaagataccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 334 - DNA, 5964 bp, synthetic construct
  misc_feature 1..5964: note = synthetic sequence for use in compositions and/or methods
  source 1..5964: mol_type = other DNA
atggctcggaccaagcagaccgccagaaagagcaccggcggcggacctagcagcggcgcccctcctccatctggcggatctcctgccggcagccccacatccaccgaggaaggcacaagcgagtccgccacccctgaaagcggccccggcaccagcacaggaggttccggaggcggtggacctatggaaatctacaagaccgtgtccgcttggaagcgccagcccgtgcgggtgctcagcctgtttagaaacatcgacaaggtgctgaaaagcctgggattcctggaatccggatctggcagcggcggcggcaccctgaagtacgtggaagatgtgacaaacgtggttaggcgggacgtcgagaagtggggcccttttgacctggtgtacggctccacccagcccctgggctccagctgtgaccggtgccccggctggtacatgttccagttccacagaatactgcagtacgccctgcctagacaggagagccagcggcctttcttctggatcttcatggacaacctgcttctgaccgaagatgatcaggagacaacaaccagattcctgcagaccgaagccgtgaccctgcaagacgtgcggggccgggactaccagaacgctatgagagtgtggtccaacatccccggcctgaagagcaagcacgcccccctgacccctaaagaagaagagtacctgcaggcccaggtccggtcccggagcaagctggacgcccctaaggtggacctgctggtgaagaactgcctgctgcctctgcgggaatacttcaagtacttctctcagaacagcctgcccctgggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtggccacaaatttcagcctgctgaagcaggccggcgacgtggaagagaatcctggccccagcgagctgatcaaagagaacatgcacatgaagctgtacatggaaggcaccgtggacaaccatcacttcaagtgcaccagcgagggcgagggcaagccctacgagggcacacagaccatgagaatcaaggtggtggaaggaggcccactgcccttcgccttcgacatcctggccaccagctttctgtacggctcaaagaccttcatcaaccacacccagggcatccctgatttcttcaagcagagcttccctgagggatttacctgggagagagtgacaacttatgaagatggcggagtgctgaccgccacacaagataccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 335 - DNA, 5970 bp, synthetic construct
  misc_feature 1..5970: note = synthetic sequence for use in compositions and/or methods
  source 1..5970: mol_type = other DNA
atggctcggaccaagcagaccgccagaaagagcaccggcggcggacctagcagcggcgcccctcctccatctggcggatctcctgccggcagccccacatccaccgaggaaggcacaagcgagtccgccacccctgaaagcggccccggcaccagcacaggaggttccggaggcggttctggtggacctatggaaatctacaagaccgtgtccgcttggaagcgccagcccgtgcgggtgctcagcctgtttagaaacatcgacaaggtgctgaaaagcctgggattcctggaatccggatctggcagcggcggcggcaccctgaagtacgtggaagatgtgacaaacgtggttaggcgggacgtcgagaagtggggcccttttgacctggtgtacggctccacccagcccctgggctccagctgtgaccggtgccccggctggtacatgttccagttccacagaatactgcagtacgccctgcctagacaggagagccagcggcctttcttctggatcttcatggacaacctgcttctgaccgaagatgatcaggagacaacaaccagattcctgcagaccgaagccgtgaccctgcaagacgtgcggggccgggactaccagaacgctatgagagtgtggtccaacatccccggcctgaagagcaagcacgcccccctgacccctaaagaagaagagtacctgcaggcccaggtccggtcccggagcaagctggacgcccctaaggtggacctgctggtgaagaactgcctgctgcctctgcgggaatacttcaagtacttctctcagaacagcctgcccctgggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtggccacaaatttcagcctgctgaagcaggccggcgacgtggaagagaatcctggccccagcgagctgatcaaagagaacatgcacatgaagctgtacatggaaggcaccgtggacaaccatcacttcaagtgcaccagcgagggcgagggcaagccctacgagggcacacagaccatgagaatcaaggtggtggaaggaggcccactgcccttcgccttcgacatcctggccaccagctttctgtacggctcaaagaccttcatcaaccacacccagggcatccctgatttcttcaagcagagcttccctgagggatttacctgggagagagtgacaacttatgaagatggcggagtgctgaccgccacacaagataccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 336 - DNA, 5976 bp, synthetic construct
  misc_feature 1..5976: note = synthetic sequence for use in compositions and/or methods
  source 1..5976: mol_type = other DNA
atggctcggaccaagcagaccgccagaaagagcaccggcggcggacctagcagcggcgcccctcctccatctggcggatctcctgccggcagccccacatccaccgaggaaggcacaagcgagtccgccacccctgaaagcggccccggcaccagcacaggaggttccggaggcggttctggtggtggaggacctatggaaatctacaagaccgtgtccgcttggaagcgccagcccgtgcgggtgctcagcctgtttagaaacatcgacaaggtgctgaaaagcctgggattcctggaatccggatctggcagcggcggcggcaccctgaagtacgtggaagatgtgacaaacgtggttaggcgggacgtcgagaagtggggcccttttgacctggtgtacggctccacccagcccctgggctccagctgtgaccggtgccccggctggtacatgttccagttccacagaatactgcagtacgccctgcctagacaggagagccagcggcctttcttctggatcttcatggacaacctgcttctgaccgaagatgatcaggagacaacaaccagattcctgcagaccgaagccgtgaccctgcaagacgtgcggggccgggactaccagaacgctatgagagtgtggtccaacatccccggcctgaagagcaagcacgcccccctgacccctaaagaagaagagtacctgcaggcccaggtccggtcccggagcaagctggacgcccctaaggtggacctgctggtgaagaactgcctgctgcctctgcgggaatacttcaagtacttctctcagaacagcctgcccctgggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtggccacaaatttcagcctgctgaagcaggccggcgacgtggaagagaatcctggccccagcgagctgatcaaagagaacatgcacatgaagctgtacatggaaggcaccgtggacaaccatcacttcaagtgcaccagcgagggcgagggcaagccctacgagggcacacagaccatgagaatcaaggtggtggaaggaggcccactgcccttcgccttcgacatcctggccaccagctttctgtacggctcaaagaccttcatcaaccacacccagggcatccctgatttcttcaagcagagcttccctgagggatttacctgggagagagtgacaacttatgaagatggcggagtgctgaccgccacacaagataccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 337 - DNA, 5982 bp, synthetic construct
  misc_feature 1..5982: note = synthetic sequence for use in compositions and/or methods
  source 1..5982: mol_type = other DNA
atggctcggaccaagcagaccgccagaaagagcaccggcggcggacctagcagcggcgcccctcctccatctggcggatctcctgccggcagccccacatccaccgaggaaggcacaagcgagtccgccacccctgaaagcggccccggcaccagcacaggaggttccggaggcggttctggtggtggatctggcggacctatggaaatctacaagaccgtgtccgcttggaagcgccagcccgtgcgggtgctcagcctgtttagaaacatcgacaaggtgctgaaaagcctgggattcctggaatccggatctggcagcggcggcggcaccctgaagtacgtggaagatgtgacaaacgtggttaggcgggacgtcgagaagtggggcccttttgacctggtgtacggctccacccagcccctgggctccagctgtgaccggtgccccggctggtacatgttccagttccacagaatactgcagtacgccctgcctagacaggagagccagcggcctttcttctggatcttcatggacaacctgcttctgaccgaagatgatcaggagacaacaaccagattcctgcagaccgaagccgtgaccctgcaagacgtgcggggccgggactaccagaacgctatgagagtgtggtccaacatccccggcctgaagagcaagcacgcccccctgacccctaaagaagaagagtacctgcaggcccaggtccggtcccggagcaagctggacgcccctaaggtggacctgctggtgaagaactgcctgctgcctctgcgggaatacttcaagtacttctctcagaacagcctgcccctgggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtggccacaaatttcagcctgctgaagcaggccggcgacgtggaagagaatcctggccccagcgagctgatcaaagagaacatgcacatgaagctgtacatggaaggcaccgtggacaaccatcacttcaagtgcaccagcgagggcgagggcaagccctacgagggcacacagaccatgagaatcaaggtggtggaaggaggcccactgcccttcgccttcgacatcctggccaccagctttctgtacggctcaaagaccttcatcaaccacacccagggcatccctgatttcttcaagcagagcttccctgagggatttacctgggagagagtgacaacttatgaagatggcggagtgctgaccgccacacaagataccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 338 - DNA, 5988 bp, synthetic construct
  misc_feature 1..5988: note = synthetic sequence for use in compositions and/or methods
  source 1..5988: mol_type = other DNA
atggctcggaccaagcagaccgccagaaagagcaccggcggcggacctagcagcggcgcccctcctccatctggcggatctcctgccggcagccccacatccaccgaggaaggcacaagcgagtccgccacccctgaaagcggccccggcaccagcacaggaggttccggaggcggttctggtggtggatctggcggcggaggacctatggaaatctacaagaccgtgtccgcttggaagcgccagcccgtgcgggtgctcagcctgtttagaaacatcgacaaggtgctgaaaagcctgggattcctggaatccggatctggcagcggcggcggcaccctgaagtacgtggaagatgtgacaaacgtggttaggcgggacgtcgagaagtggggcccttttgacctggtgtacggctccacccagcccctgggctccagctgtgaccggtgccccggctggtacatgttccagttccacagaatactgcagtacgccctgcctagacaggagagccagcggcctttcttctggatcttcatggacaacctgcttctgaccgaagatgatcaggagacaacaaccagattcctgcagaccgaagccgtgaccctgcaagacgtgcggggccgggactaccagaacgctatgagagtgtggtccaacatccccggcctgaagagcaagcacgcccccctgacccctaaagaagaagagtacctgcaggcccaggtccggtcccggagcaagctggacgcccctaaggtggacctgctggtgaagaactgcctgctgcctctgcgggaatacttcaagtacttctctcagaacagcctgcccctgggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtggccacaaatttcagcctgctgaagcaggccggcgacgtggaagagaatcctggccccagcgagctgatcaaagagaacatgcacatgaagctgtacatggaaggcaccgtggacaaccatcacttcaagtgcaccagcgagggcgagggcaagccctacgagggcacacagaccatgagaatcaaggtggtggaaggaggcccactgcccttcgccttcgacatcctggccaccagctttctgtacggctcaaagaccttcatcaaccacacccagggcatccctgatttcttcaagcagagcttccctgagggatttacctgggagagagtgacaacttatgaagatggcggagtgctgaccgccacacaagataccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 339 - DNA, 6183 bp, synthetic construct
  misc_feature 1..6183: note = synthetic sequence for use in compositions and/or methods
  source 1..6183: mol_type = other DNA
atggctcggaccaagcagaccgccagaaagagcaccggcggcggagcaagctctggcgccggatcaagttctggcggatctgcagccggcagcggatcatccggtgctagtggctcaagcggatccgccagtagcggcagcggctcaggcggtagcggaatgggacctatggaaatctacaagaccgtgtccgcttggaagcgccagcccgtgcgggtgctcagcctgtttagaaacatcgacaaggtgctgaaaagcctgggattcctggaatccggatctggcagcggcggcggcaccctgaagtacgtggaagatgtgacaaacgtggttaggcgggacgtcgagaagtggggcccttttgacctggtgtacggctccacccagcccctgggctccagctgtgaccggtgccccggctggtacatgttccagttccacagaatactgcagtacgccctgcctagacaggagagccagcggcctttcttctggatcttcatggacaacctgcttctgaccgaagatgatcaggagacaacaaccagattcctgcagaccgaagccgtgaccctgcaagacgtgcggggccgggactaccagaacgctatgagagtgtggtccaacatccccggcctgaagagcaagcacgcccccctgacccctaaagaagaagagtacctgcaggcccaggtccggtcccggagcaagctggacgcccctaaggtggacctgctggtgaagaactgcctgctgcctctgcgggaatacttcaagtacttctctcagaacagcctgcccctgggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtgtccggctctgaaacccctggaacctccgagagcgccacacctgaaagcagaaccctggtgaccttcaaggacgtgttcgtggacttcacccgcgaggaatggaagctcctggacaccgcccagcaaatcgtgtaccggaacgtgatgctggagaattacaagaacctggtgtctctgggctaccagctgacgaagcctgacgtcatcctgagactggaaaagggagaggagcctgccacaaatttcagcctgctgaagcaggccggcgacgtggaagagaatcctggccccagcgagctgatcaaagagaacatgcacatgaagctgtacatggaaggcaccgtggacaaccatcacttcaagtgcaccagcgagggcgagggcaagccctacgagggcacacagaccatgagaatcaaggtggtggaaggaggcccactgcccttcgccttcgacatcctggccaccagctttctgtacggctcaaagaccttcatcaaccacacccagggcatccctgatttcttcaagcagagcttccctgagggatttacctgggagagagtgacaacttatgaagatggcggagtgctgaccgccacacaagataccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 340 - DNA, 6777 bp, synthetic construct
  misc_feature 1..6777: note = synthetic sequence for use in compositions and/or methods
  source 1..6777: mol_type = other DNA
atgaaccacgaccaggagtttgatcctcctaaggtgtatcctcctgtgcccgcagaaaagcgaaaacctatcagagtgctgtcactgttcgacggcatcgccaccggcctgctggtgctgaaggacctcggcatccaggtggaccggtacatcgctagcgaggtgtgcgaggacagcatcaccgtgggcatggtgaggcaccagggcaagatcatgtacgtgggagatgtgagaagcgtgacccagaaacacatccaggagtggggccccttcgacctggtgatcggcggcagcccctgcaacgacctgagcatcgtgaatccagccagaaagggcctgtacgagggcactggcagactgtttttcgagttctacagactgctgcacgatgccagacctaaagagggagatgacaggcctttcttctggctgttcgagaacgtggtggccatgggcgtgagtgataagagagatatcagcagattcctggaatctaaccccgtcatgatcgacgccaaggaggtgtccgccgcccaccgggccagatacttctggggaaatctgcctggcatgaacagacctcttgcttctaccgtgaacgacaagctggaactgcaggagtgcctggaacacggccggatcgccaaattctccaaggtgagaacaatcaccacaagaagcaacagcattaagcagggaaaggaccaacatttccccgttttcatgaacgagaaggaggatatcctgtggtgcaccgagatggaaagagtgtttggctttccagtgcactacaccgacgtttctaatatgagcagactggccagacaaagactgctgggcagaagctggagcgtgcctgtgatccggcacctgtttgcccctctgaaggaatatttcgcctgtgtgtcttctggcaactctaatgctaacagcagaggacctagcttcagcagcggactggttccactgagcctgagaggcagccatatgggacctatggaaatctacaagaccgtgtccgcttggaagcgccagcccgtgcgggtgctcagcctgtttagaaacatcgacaaggtgctgaaaagcctgggattcctggaatccggatctggcagcggcggcggcaccctgaagtacgtggaagatgtgacaaacgtggttaggcgggacgtcgagaagtggggcccttttgacctggtgtacggctccacccagcccctgggctccagctgtgaccggtgccccggctggtacatgttccagttccacagaatactgcagtacgccctgcctagacaggagagccagcggcctttcttctggatcttcatggacaacctgcttctgaccgaagatgatcaggagacaacaaccagattcctgcagaccgaagccgtgaccctgcaagacgtgcggggccgggactaccagaacgctatgagagtgtggtccaacatccccggcctgaagagcaagcacgcccccctgacccctaaagaagaagagtacctgcaggcccaggtccggtcccggagcaagctggacgcccctaaggtggacctgctggtgaagaactgcctgctgcctctgcgggaatacttcaagtacttctctcagaacagcctgcccctgggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtggccacaaatttcagcctgctgaagcaggccggcgacgtggaagagaatcctggccccagcgagctgatcaaagagaacatgcacatgaagctgtacatggaaggcaccgtggacaaccatcacttcaagtgcaccagcgagggcgagggcaagccctacgagggcacacagaccatgagaatcaaggtggtggaaggaggcccactgcccttcgccttcgacatcctggccaccagctttctgtacggctcaaagaccttcatcaaccacacccagggcatccctgatttcttcaagcagagcttccctgagggatttacctgggagagagtgacaacttatgaagatggcggagtgctgaccgccacacaagataccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 341 - DNA, 5757 bp, synthetic construct
  misc_feature 1..5757: note = synthetic sequence for use in compositions and/or methods
  source 1..5757: mol_type = other DNA
atgtctccactggaaatgtataagaccgtgccctggaagcgggaaccccgggtcctgtctctgttcggcgacatcaagaaactggagctgaccagcctcggcttcctggaaggcagcggaagactgaagcacctggacgacgttacagatgtggtgcgcagagatgtcgaggaatggggcccttttgatctggtgtacggcagcacacctccactgggccattgtgacagccctggctggtacctgttccagttccacagactgctgcaatacgccagaccccccggatctcctcagccttttttctggatgttcgtggacaacctgctgctgaccgacgaccaggccaccgccacacggttcctgcctggagagggccctgagcctgtgaccctgcaacctgatgtgaggggcagagtgctgcagaacgccgtgcgggtgtggagcaatatccccgccgtgaagtccagccacgccctggctcctgaggaagagctgagccttctggcccagcagagagccctgcagggcccagctctggtgaaaaactgctggttcctgcccctcagagagtactttaagtacttcagccagaccaactccctgcctctgggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtggccacaaatttcagcctgctgaagcaggccggcgacgtggaagagaatcctggccccagcgagctgatcaaagagaacatgcacatgaagctgtacatggaaggcaccgtggacaaccatcacttcaagtgcaccagcgagggcgagggcaagccctacgagggcacacagaccatgagaatcaaggtggtggaaggaggcccactgcccttcgccttcgacatcctggccaccagctttctgtacggctcaaagaccttcatcaaccacacccagggcatccctgatttcttcaagcagagcttccctgagggatttacctgggagagagtgacaacttatgaagatggcggagtgctgaccgccacacaagataccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 342 - DNA, 5781 bp, synthetic construct
  misc_feature 1..5781: note = synthetic sequence for use in compositions and/or methods
  source 1..5781: mol_type = other DNA
atgtctccacttgagatgtacaagaccgtgtccgcctggaagcggcagcccatgcgggtgctgagcctgttcggcaacatcgacaaggaactgaaaagcctcggcttcctggagagcggctccggcagcgaggaaggcagactgaagtacctggaagatgtgacaaacgtggtgcggagagatgtggaatggggccctttcgacctggtgtacggctctacacagcctctgggctacagctgtgactgccctggatggtatatgttccaatttcacagaatcctgcaatacgccagaccccaccctggatctcagcagccttttttctggatcttcgtggataatctgctgctgacagaggacgaccaggtgaccgccgctagattccagggcgaggccgtgaccctgcaggacgtccgcggaagagtgctgcagaatgccgttcgggtctggtccaacatccccggcctgaagagcctgagcaagcacgccctgacccctaaagaagagcagagcctggcccaggtgaggaccagagccaagctggccgctcagaaagtggaccccctggtgaagaactgcctgctgccactgagagagtacttcaagtacttcagccagaacagcctgcctctgggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtggccacaaatttcagcctgctgaagcaggccggcgacgtggaagagaatcctggccccagcgagctgatcaaagagaacatgcacatgaagctgtacatggaaggcaccgtggacaaccatcacttcaagtgcaccagcgagggcgagggcaagccctacgagggcacacagaccatgagaatcaaggtggtggaaggaggcccactgcccttcgccttcgacatcctggccaccagctttctgtacggctcaaagaccttcatcaaccacacccagggcatccctgatttcttcaagcagagcttccctgagggatttacctgggagagagtgacaacttatgaagatggcggagtgctgaccgccacacaagataccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 343 - DNA, 5754 bp, synthetic construct
  misc_feature 1..5754: note = synthetic sequence for use in compositions and/or methods
  source 1..5754: mol_type = other DNA
atgagccctcttgagatgtataagaccgtgcccgtgtggaaacgggagcctgtgagagtgctgtccctgttcggcgacatcaagaaggaactgaccagcctgggcttcctggaaggcagcgaccccggaagactgaagcacctggacgatgtgaccgacgtggtgaggcgggacgtggaagagtggggccctttcgacctggtgtacggcagcacccctcctctgggacatgcctgcgaccaccctccaggctggtacctgtttcaatttcacagactgcagtacgccagacctagacccggctctcagcccttcttctggatgttcgtggacaacctggtgctgaccgatgatagagccaccagattcctgggagagggccctacccctgttacaatccaggattgtggccgccagaacgccgtcgtgtggtccaacatccccgccgtgtctagacacagcgccctgagcgaggagctgtctctgctggcccaggacagacagcgggctaaacctcagggcccagctctggtcaagaattgctggttcctgcctctgcgggaatactttaagtacttcagcacagagctgacaagcagcctgcccctcggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtggccacaaatttcagcctgctgaagcaggccggcgacgtggaagagaatcctggccccagcgagctgatcaaagagaacatgcacatgaagctgtacatggaaggcaccgtggacaaccatcacttcaagtgcaccagcgagggcgagggcaagccctacgagggcacacagaccatgagaatcaaggtggtggaaggaggcccactgcccttcgccttcgacatcctggccaccagctttctgtacggctcaaagaccttcatcaaccacacccagggcatccctgatttcttcaagcagagcttccctgagggatttacctgggagagagtgacaacttatgaagatggcggagtgctgaccgccacacaagataccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 344 - DNA, 5769 bp, synthetic construct
  misc_feature 1..5769: note = synthetic sequence for use in compositions and/or methods
  source 1..5769: mol_type = other DNA
atgtccccactggaaatgtacaagaccgtgcccgtgtggaagcgggaacctgtgcgggtgctgagcctgtttggcgacatcaagaaagagctgacctccctgggattcctcgagggaagccccggcagactgaagcacctggacgacgtgaccgacgtggtcaggcgggacgtggaagagtggggcccttttgatctggtgtacggcagcacccctccactgggacacgcctgtgatcatcctcctggctggtatctgttccagttccacagactgctgcagtacgccagacctagacccggctctcagccttttttctggatgttcgtggacaatctggttctgacagatagagccgctacaagattcctgggcgagggccccacccctgtcacaatccaggacgtgtgcggcagagctcagaacgccgtggtgtggagcaacatccccgccgtgaaacctagccactctgccctggaggaagaactgtctctgctggcccaggatagacagcgggccaagcccgctcaaggcggcccagccctggtgaagaactgctggttcctgcctcttagagagtacttcaagtacttcagcaccgagctgacaagcagcctgcctctgggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtggccacaaatttcagcctgctgaagcaggccggcgacgtggaagagaatcctggccccagcgagctgatcaaagagaacatgcacatgaagctgtacatggaaggcaccgtggacaaccatcacttcaagtgcaccagcgagggcgagggcaagccctacgagggcacacagaccatgagaatcaaggtggtggaaggaggcccactgcccttcgccttcgacatcctggccaccagctttctgtacggctcaaagaccttcatcaaccacacccagggcatccctgatttcttcaagcagagcttccctgagggatttacctgggagagagtgacaacttatgaagatggcggagtgctgaccgccacacaagataccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 345 - DNA, 5784 bp, synthetic construct
  misc_feature 1..5784: note = synthetic sequence for use in compositions and/or methods
  source 1..5784: mol_type = other DNA
atgagccctgagatctacaagaccgtgtccgcctggaagcggcagccagtgcgggtgctgagcctgttcggcaacatcgacaaggagctgaaaagcctcggcttcctggaatccggatctggaagcgagggcggcaccctgaaatacgtggaagatgtcacaaacgtggtgcgcagagatgtggaaaagtggggccctttcgacctggtctacggcagcacccagcctctgggctacagctgcgacagatgtcctggatggtatatgttccaatttcacagaatcctgcaatacgccagacccagacagagccagcagcccttcttctggatcttcgtggacaacctgctgctgacagaggacgatcaggtgacaacagtgcggttcctgcagaccgaggccgtgaccctgcaggacgtgaggggcagagttctgcagaatgccgtgagagtgtggtccaacatccccggcctgaagctgtctaagcacgccctgacccctaaggaagagcagtctctgcaggctcaggtgcggaccagaagcaagctggccgctcagaaagtggaccccctggtgaagaactgcctgctgcctctgagagagtactttaagtacttcagccaaaatagccttcctctgggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtggccacaaatttcagcctgctgaagcaggccggcgacgtggaagagaatcctggccccagcgagctgatcaaagagaacatgcacatgaagctgtacatggaaggcaccgtggacaaccatcacttcaagtgcaccagcgagggcgagggcaagccctacgagggcacacagaccatgagaatcaaggtggtggaaggaggcccactgcccttcgccttcgacatcctggccaccagctttctgtacggctcaaagaccttcatcaaccacacccagggcatccctgatttcttcaagcagagcttccctgagggatttacctgggagagagtgacaacttatgaagatggcggagtgctgaccgccacacaagataccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 346 - DNA, 5787 bp, synthetic construct
  misc_feature 1..5787: note = synthetic sequence for use in compositions and/or methods
  source 1..5787: mol_type = other DNA
atgtcccctgttgagatctacaagaccgtgtccgcctggaagcggcagccaatcagagtgctgagcctgttcggcaatattgacaaggaactgaagtctctgggcttcctggaaagcggcagccacagcgagggcggcacactgaagtacgtggaagatgtgaccaacgtggtgcggagagatgtggaaaagtggggacctttcgacctgctgtacggcagcacccagcctctgggcggaagctgcgacaggtgtcctggctggtacatgttccaatttcatagaatcctgcagtacgccagacctagacaggagtctcagcccttcttctggatcttcatggataacctgctgctcacagaggacgaccagatgaccaccgtgcggttcctgcaaacagaggccgtcaccctgcgcgacgtgagatctagagtgctgcagaacgccgtccgggtgtggagcaacatccccggtcttaaaagcaagcacgaggctctgtccccaaaagaggaagagagcctgcagggccacgtgcggaccagatctaagctggccgctcctaaagtggaccccctggtgaagaactgcctgctgcctctgagagagtactttaagtatttcagccagagcagcctgcccctgggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtggccacaaatttcagcctgctgaagcaggccggcgacgtggaagagaatcctggccccagcgagctgatcaaagagaacatgcacatgaagctgtacatggaaggcaccgtggacaaccatcacttcaagtgcaccagcgagggcgagggcaagccctacgagggcacacagaccatgagaatcaaggtggtggaaggaggcccactgcccttcgccttcgacatcctggccaccagctttctgtacggctcaaagaccttcatcaaccacacccagggcatccctgatttcttcaagcagagcttccctgagggatttacctgggagagagtgacaacttatgaagatggcggagtgctgaccgccacacaagataccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 347 - DNA, 5787 bp, synthetic construct
  misc_feature 1..5787: note = synthetic sequence for use in compositions and/or methods
  source 1..5787: mol_type = other DNA
atgagccctctggagatgtataagaccgtgcctgtgtggaaaagagagcctgtgcgggtgctgagcctgtttggcgacatcaagaaagagctgacaagcctgggcttcctggaatctggatctggccctggcagactgagacacctggacgatgtgacagatgtcgtgcggcgggacgtcgaggaatggggccccttcgatctgacctacggctctacacctcctctgggccacacatgtgaccaccctccaggctggtacctgttccagttccacagagtgctgcagtacgcccgccccagaagaggcagccagcaacctttcttctggatgttcgtggacaacctggttctgaccgaggaagatagagccgtggccacaagattcctggaaatggaccccgtgaccatccagcacgtgagaggaagaaccacccagaacgccgtgcacgtgtggtccaatatccccgctgtgcggagcagacatagcgccctggtgtcccaagaggaactggctctgctggcccaggaccggcagcgggccaagcctccagctcaggagcctgccgccctggtgaagaactgcttcctcccccttagagagtactttaagtactttagcaccgagctgaccagcagcctgggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtggccacaaatttcagcctgctgaagcaggccggcgacgtggaagagaatcctggccccagcgagctgatcaaagagaacatgcacatgaagctgtacatggaaggcaccgtggacaaccatcacttcaagtgcaccagcgagggcgagggcaagccctacgagggcacacagaccatgagaatcaaggtggtggaaggaggcccactgcccttcgccttcgacatcctggccaccagctttctgtacggctcaaagaccttcatcaaccacacccagggcatccctgatttcttcaagcagagcttccctgagggatttacctgggagagagtgacaacttatgaagatggcggagtgctgaccgccacacaagataccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 348 - DNA, 5790 bp, synthetic construct
  misc_feature 1..5790: note = synthetic sequence for use in compositions and/or methods
  source 1..5790: mol_type = other DNA
atgagccccgagcagatgtacaaaaccgtgcccgtgtggaagagacagccagtgcgggtgctctccctgttcggcaacatcaagcaggagctgaccagcctgggcttcctggaaaccggctctcaagccggcagactgagacatctgaaggacgtgacagatgtcgtgcggcgggacgtggaagagtggggacctttcgacctggtctacggcagcacccctgccagaggccacacatgtgatagaagccctggctggttcctgtttcacttccacagactgctgcaatacgccagacctcctccatctagcccccagccttttttctggatgttcgtggacaacctgctgctgacaagtgaagatcaggccaccgccacaagattcctggaaaccgagcctaccaccctgcaggacatcaggggacaggtgctgcacggcgccgtgcgggtgtggtccaacatccccgctgttcggagcagacactctgctctggcccctgaggaggaggccagcctgctcgcccacgtgaccagaggaacagagctgagcgcccgcggccctgcttctctggtgaagaactgcttcctgcccctgcgggaatacttcagctactttagccagaatagcctgcctctgtataagggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtggccacaaatttcagcctgctgaagcaggccggcgacgtggaagagaatcctggccccagcgagctgatcaaagagaacatgcacatgaagctgtacatggaaggcaccgtggacaaccatcacttcaagtgcaccagcgagggcgagggcaagccctacgagggcacacagaccatgagaatcaaggtggtggaaggaggcccactgcccttcgccttcgacatcctggccaccagctttctgtacggctcaaagaccttcatcaaccacacccagggcatccctgatttcttcaagcagagcttccctgagggatttacctgggagagagtgacaacttatgaagatggcggagtgctgaccgccacacaagataccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 349 - DNA, 5787 bp, synthetic construct
  misc_feature 1..5787: note = synthetic sequence for use in compositions and/or methods
  source 1..5787: mol_type = other DNA
atgtcccctctggagatgtacaagacagtgcccgcttggaagcgggaacctgtgcgcgtgctgtctctgttcggcgacatcaagaaagagctgctcagcctgggtttcctggagagcggatctggacaggagagactgagacacctggaagatgtgaccgacgtggtgcggcgggacgtcgaggaatggggcccctttgacctgctgtacggcgccacccctccactgggccacccctgtgaacaccctcctggctggtatgttttccaatttcatagactgctgcagtacgccagacctagaccaggcagcggccagcctttcttctggatgttcgtggacaacctggtcctcaccgccgaggaccgggctgtggcctctagattcctggagacagaccccgtgaccatccaggatgccagaggcagagccgtgcaggacgccgtgcgggtgtggtccaatctgcctgccgtgaaaagcagagatagcgccctggcccctgaggatgagctgagcctgagggcctgggacagacagagagccaagctgcccgcccagggccctgctgctctggtgaagaactgcttcctgcctctgcgggaatactttaagtacttcagcatggaactgaccagcagcctgggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtggccacaaatttcagcctgctgaagcaggccggcgacgtggaagagaatcctggccccagcgagctgatcaaagagaacatgcacatgaagctgtacatggaaggcaccgtggacaaccatcacttcaagtgcaccagcgagggcgagggcaagccctacgagggcacacagaccatgagaatcaaggtggtggaaggaggcccactgcccttcgccttcgacatcctggccaccagctttctgtacggctcaaagaccttcatcaaccacacccagggcatccctgatttcttcaagcagagcttccctgagggatttacctgggagagagtgacaacttatgaagatggcggagtgctgaccgccacacaagataccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 350 - DNA, 5796 bp, synthetic construct
  misc_feature 1..5796: note = synthetic sequence for use in compositions and/or methods
  source 1..5796: mol_type = other DNA
atgagcccccttgagatgtacaagacagtgtccgcctggaagcggcagcccatgagagtgctgtctctgttcggcaacatcgacaaggaactgaaaagcctgggcttcctggaaagcggcagcagaaccgaggaaggcagactgaagtacctggatgatgttacaaacgtggtgcgcagagatgtggaacggtggggacctttcgacctggtctacggcagcacccagccactgggatattcttgtgaccactgccctggatggtacatgttccagttccacagaatcctgcaatacgccagacctcatcctggcagccagcagccatttttctggatctttgtggacaacctgctgctgagcgaggacgatcaggtgaccgccgctagattcttccagaccgaggccgtgacactgcaggacgtgcggggcagggtgctgcaaaatgccgtgcgggtctggtctaatatccctggcctgaagtccaagcacagcgctctgacccctaaggaagagcagagcctggagggccacgtgcggaccagagccaaggtggccgcccagaaaaccgacgccctggtgaagaactgcctgctgcctctgagagagtactttaagtacttcagccagaaccccctccccctgtacaaaggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtggccacaaatttcagcctgctgaagcaggccggcgacgtggaagagaatcctggccccagcgagctgatcaaagagaacatgcacatgaagctgtacatggaaggcaccgtggacaaccatcacttcaagtgcaccagcgagggcgagggcaagccctacgagggcacacagaccatgagaatcaaggtggtggaaggaggcccactgcccttcgccttcgacatcctggccaccagctttctgtacggctcaaagaccttcatcaaccacacccagggcatccctgatttcttcaagcagagcttccctgagggatttacctgggagagagtgacaacttatgaagatggcggagtgctgaccgccacacaagataccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 351 - DNA, 5787 bp, synthetic construct
  misc_feature 1..5787: note = synthetic sequence for use in compositions and/or methods
  source 1..5787: mol_type = other DNA
atgtcccctcttgagatgtacaagaccgtgcccgtgtggaagcgggaacctgtgcgggtgctctctctgttcggcgacatcaagaaagagctgacatctctgggcttcctggaaaacggcagcgaccccggcagactgaagcacctggacgacgttacaaacaccgtccgcagagatgtggaagagtggggccctttcgacctggtctacggctccacccctccactgggacacgcctgtgaccaccctccaggatggtatctgtttcagttccacagagtgctgcagtacgccagacccagacctggcagcccccaggccttcttctggatgttcgtggacaacctggtgctgaccgaagatgatagagctgtggccacacggttcctggagacagatcctgtgaccatccaggacgtgtgcggcagggccgtgcggaacgccgtgcatgtgtggagcaacatccctgctgtgaaaagcagacacagcgccctgttcagccaggaggaatcttttctcagagcccaagaccggcagagagccaagcctcctgccagaggccccgctaagctggtgaagaattgcttcctgcctctgagagagtacttcaagtactttagcaccgagttcaccagcagcctgggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtggccacaaatttcagcctgctgaagcaggccggcgacgtggaagagaatcctggccccagcgagctgatcaaagagaacatgcacatgaagctgtacatggaaggcaccgtggacaaccatcacttcaagtgcaccagcgagggcgagggcaagccctacgagggcacacagaccatgagaatcaaggtggtggaaggaggcccactgcccttcgccttcgacatcctggccaccagctttctgtacggctcaaagaccttcatcaaccacacccagggcatccctgatttcttcaagcagagcttccctgagggatttacctgggagagagtgacaacttatgaagatggcggagtgctgaccgccacacaagataccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 352 - DNA, 5787 bp, synthetic construct
  misc_feature 1..5787: note = synthetic sequence for use in compositions and/or methods
  source 1..5787: mol_type = other DNA
atgaatcctctggaaatgttcgaaaccgtgcctgtgtggcggagacagcctgtgcgggttctgagcctgttcgaggacatcaagaaagagctgacaagcctgggcttccttgagagcggcagcgaccccggacagctgaagcacgtggtggatgtgaccgacaccgtgcggaaggacgtggaagagtggggccctttcgacctggtctacggcgccacacctccactcggccacacctgtgatagaccccccagctggtatctgtttcagttccatagactgctgcaatacgccagacctaaacctggcagccccagaccattcttctggatgtttgtggacaacctggtgctgaacaaagaggatctggacgtggcctctagattcctggaaatggaacctgtgaccatccccgatgtgcacggcggaagcctgcagaatgccgtgcgggtgtggtccaacatccctgctatcagatccagacactgggccctggtcagcgaggaagagctgtctctgctggctcagaacaagcagagcagcaagctggccgccaagtggcctaccaagctggtgaagaactgcttcctgcctctgcgcgagtactttaagtacttctctacagagctgaccagctctctgggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtggccacaaatttcagcctgctgaagcaggccggcgacgtggaagagaatcctggccccagcgagctgatcaaagagaacatgcacatgaagctgtacatggaaggcaccgtggacaaccatcacttcaagtgcaccagcgagggcgagggcaagccctacgagggcacacagaccatgagaatcaaggtggtggaaggaggcccactgcccttcgccttcgacatcctggccaccagctttctgtacggctcaaagaccttcatcaaccacacccagggcatccctgatttcttcaagcagagcttccctgagggatttacctgggagagagtgacaacttatgaagatggcggagtgctgaccgccacacaagataccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 353 - DNA, 5796 bp, synthetic construct
  misc_feature 1..5796: note = synthetic sequence for use in compositions and/or methods
  source 1..5796: mol_type = other DNA
atgggctctctggaagtgttcaagaccgtgcctgcttggaagcgggagcctatccgggtcctgagccttttcggcgacatcagaaaggaactgaccagcctgggatttctggaaagcggctctggcagcgaggagggcaaactgaagtacctggacgacgtgaccgacgtggtgcggagagatgtgggcaagtggggacctttcgacctgatgtacggctctacacagcctagatcccacagctgccacaactgccccgcttggtacatgtatcagtttcacagaatcctgcaatacgcccaacctaacagcaagagccagcagcccttcttctggatgttcgccgacaacctgctgctgtctgatgaggacgtgcgcaccgccaataggttcttcgagatgcagttcgtgatcctgcaggatgtttgtgatagagtgccacagaacgccgtgcgggtctggtccaacatccccgccctgagaagcagacatatggccctgacacctgaggaagaagagagcctgaaagctcaggtgaaggccaaagccaagctggccgtgcagggccctccctccctcgtgaagaactgcttcctgcctctgagagagtactttaagtacttcagcgagaatagcctgcctccataccccggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtggccacaaatttcagcctgctgaagcaggccggcgacgtggaagagaatcctggccccagcgagctgatcaaagagaacatgcacatgaagctgtacatggaaggcaccgtggacaaccatcacttcaagtgcaccagcgagggcgagggcaagccctacgagggcacacagaccatgagaatcaaggtggtggaaggaggcccactgcccttcgccttcgacatcctggccaccagctttctgtacggctcaaagaccttcatcaaccacacccagggcatccctgatttcttcaagcagagcttccctgagggatttacctgggagagagtgacaacttatgaagatggcggagtgctgaccgccacacaagataccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 354 - DNA, 5787 bp, synthetic construct
  misc_feature 1..5787: note = synthetic sequence for use in compositions and/or methods
  source 1..5787: mol_type = other DNA
atgtctcctcttgagatgtaccagaccgtgcctgtgtggaagagagagcctgtgcgggtgctgtccctcttcggcgacatcaagcgggagctgacctctctgggcttcctggaagatggcgccggccctggcggcctgaaatacctggacgacgttaccgacgtggtccgcagagatgtggaagagtggggccccttcgacctgctgtacggcgctacaccccctctgggacacacatgctaccaccctcctggctggtacctgtttcagttctgcagactgcggcaatacgcccggcccccaccaggaagccctagaccttttttctggatgttcgtggacaatctggtcctgacccaggaggacgtggccgccgctacaagattcctggaaatggaacctgtgaccatccaggatgtgtgtggcagagccctgcaggacgccaccagagtgtggtccaacatccccgccgtgcggagcaagcacagcggacccatcagcgaggaagagctgagcctgctcgcccaggatagacagagggccagactgcctccacggacacccgctcagctggtgaagaactgcttcctgcctctgagagagtactttaagtatttcagcgccgagctgaccagcagcctgggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtggccacaaatttcagcctgctgaagcaggccggcgacgtggaagagaatcctggccccagcgagctgatcaaagagaacatgcacatgaagctgtacatggaaggcaccgtggacaaccatcacttcaagtgcaccagcgagggcgagggcaagccctacgagggcacacagaccatgagaatcaaggtggtggaaggaggcccactgcccttcgccttcgacatcctggccaccagctttctgtacggctcaaagaccttcatcaaccacacccagggcatccctgatttcttcaagcagagcttccctgagggatttacctgggagagagtgacaacttatgaagatggcggagtgctgaccgccacacaagataccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 355 - DNA, 5784 bp, synthetic construct
  misc_feature 1..5784: note = synthetic sequence for use in compositions and/or methods
  source 1..5784: mol_type = other DNA
atgagccccctggaaatgtacaaaaccgtgccagtttggaagagagagcccgtgcgggtgctgagcctgttcggcgacatcaagaaggaactgacctctctgggcttcctggaaaccggcagcgaccctggaaggctgaagcacctggacgatgtgaccgatgtggtgcggagagatgtgcgggagtggggcccctttgacctggtctacggctctacccctcctctgggacacgcctgtgaccatcctccaggctggtatctgttccagttccaccggatcctgcagtacagccggcctagactggcttctcagcagccttttttctggatgttcgtggacaacctggtcctgagagaagatgatagaaccaccgccacaagattcctcgagacagaccccgtgaccatccccgacgcctgcggcagagccatccacaacgccgtgcacgtgtggtccaacatccctgctgtgaaaagcagacacagcgccctggtgtccgaggaagagctgagcctgctggcccaagacaagcagcgggctaaggcccctacacagagacctgccaatctggtgaagaactgcttcctgcctctcagagagtactttaagtacttcaccgagctgacaagcagcctgggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtggccacaaatttcagcctgctgaagcaggccggcgacgtggaagagaatcctggccccagcgagctgatcaaagagaacatgcacatgaagctgtacatggaaggcaccgtggacaaccatcacttcaagtgcaccagcgagggcgagggcaagccctacgagggcacacagaccatgagaatcaaggtggtggaaggaggcccactgcccttcgccttcgacatcctggccaccagctttctgtacggctcaaagaccttcatcaaccacacccagggcatccctgatttcttcaagcagagcttccctgagggatttacctgggagagagtgacaacttatgaagatggcggagtgctgaccgccacacaagataccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 356 - DNA, 5784 bp, synthetic construct
  misc_feature 1..5784: note = synthetic sequence for use in compositions and/or methods
  source 1..5784: mol_type = other DNA
atgtcccctcaggagatctacaaaaccgtgcctgcctggaagcgggagcctgtgcgcgtgctgagcctgttcggcgacattagaaaggaactgacaagcctgggcttcctggaacccggcagcgaggccggcagactgcggcatctggaagatgtgacagacatcgtgcggcgggacgtggaagagtggggccccttcgacctggtgtacggcagcacccctgccctcggccacgcctgcgaccactctccaggctggtatctgtttcagttccacagactgctgcaatacgccaggcctagagccggatccccacaagccttcttctggatgttcgtggacaacctgctgctgaccggcgatgagcaggccatcgccgctagattcctggaaaccgagcccgtgatcctgcaggatgttagaggaagcgccctgcagaacgccgtgcgggtctggaccaacatccccgctgtgaaatctagacacagcgcatctgaggaagagctgctgctgctggcccaggacggccagagaggaacactgcctgctcagggccctagcgcccttgtgaagaactgttttctgcctctgagagagtactttaagtacttcagccagaatgccctgcctctgtacaagggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtggccacaaatttcagcctgctgaagcaggccggcgacgtggaagagaatcctggccccagcgagctgatcaaagagaacatgcacatgaagctgtacatggaaggcaccgtggacaaccatcacttcaagtgcaccagcgagggcgagggcaagccctacgagggcacacagaccatgagaatcaaggtggtggaaggaggcccactgcccttcgccttcgacatcctggccaccagctttctgtacggctcaaagaccttcatcaaccacacccagggcatccctgatttcttcaagcagagcttccctgagggatttacctgggagagagtgacaacttatgaagatggcggagtgctgaccgccacacaagataccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 357 - DNA, 5796 bp, synthetic construct
  misc_feature 1..5796: note = synthetic sequence for use in compositions and/or methods
  source 1..5796: mol_type = other DNA
atgaatcctgtgaagatgtacaagatcgtgtccgcctggaagcggcagccagtgcgggtgctgaacctgtttggcaaaatcgacaaggaactggagagcctgggcttcctggaaagcggaagcggcagcgaggaaggcagactgaagtacctggaggatgttacaaacgtggtgcggagagatgtggagagatggggccccttcgacctggtgtacggctctacccagcccctgggatattcttgcaacagatgtcctggctggtacatgttccagtttcacagaatcctgcagtacgcccagccacctagcggcagccagcagccttttttctggctgttcatggacaacctgcttctcaccgaggacgaccaggccacagccaccagattcttccaggtggaagccgtgaccctgcaagatgtgcggagcagagtgctgcaaaatgccgtgcgcgtctggtccaacatccccggactgaaaagcaagcactctgctctgacacctaaggagctgcagagcctggaaacccagacccggaccagaggcaagatggccgctcagaaagtggacctgctggtcaagacatgcctgctgcctctgagagagtacttcaagtacttcagccagaaccccctgcctctgtacaagggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtggccacaaatttcagcctgctgaagcaggccggcgacgtggaagagaatcctggccccagcgagctgatcaaagagaacatgcacatgaagctgtacatggaaggcaccgtggacaaccatcacttcaagtgcaccagcgagggcgagggcaagccctacgagggcacacagaccatgagaatcaaggtggtggaaggaggcccactgcccttcgccttcgacatcctggccaccagctttctgtacggctcaaagaccttcatcaaccacacccagggcatccctgatttcttcaagcagagcttccctgagggatttacctgggagagagtgacaacttatgaagatggcggagtgctgaccgccacacaagataccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 358 - DNA, 5790 bp, synthetic construct
  misc_feature 1..5790: note = synthetic sequence for use in compositions and/or methods
  source 1..5790: mol_type = other DNA
atgcaacctctggaaatctacgagacagtgcccgcctgcagacggaaacctctgagagtgctgagcctgttcgagcacatcgagaaggaactggctagcctgggatttctggaaaccggctctagccctggcagaatcagacatctggatgatgtgaccgacgtggtgcggagagatgttgagcagtggggccctttcgacctggtctacggcagcacaccccccctgggccacgccagcccacgcagcccaggatggtatctgtttcagttccacagaatgctgcaatacacccagcctaccgcctctacacagagaccttttttctggatgttcgtggacaatctgctgctcacccgggacgacctggtgacagccaccagattcctggaggtggaacctgctaccctgcaggacgtgcggggcagagtgctgcagggcgccatgcgggtgtggagcaacatccctgccgtgaacagcagacacaccgagctggcccctgaggccgagacagccctgctggcccagtcttgtagaagggccaaggcctccggcgagggccttgctagactgctgaagtcctgcttcctgcccctgcgggaatacttcaagtacttcccccagagccctctgcctctgagaaagggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtggccacaaatttcagcctgctgaagcaggccggcgacgtggaagagaatcctggccccagcgagctgatcaaagagaacatgcacatgaagctgtacatggaaggcaccgtggacaaccatcacttcaagtgcaccagcgagggcgagggcaagccctacgagggcacacagaccatgagaatcaaggtggtggaaggaggcccactgcccttcgccttcgacatcctggccaccagctttctgtacggctcaaagaccttcatcaaccacacccagggcatccctgatttcttcaagcagagcttccctgagggatttacctgggagagagtgacaacttatgaagatggcggagtgctgaccgccacacaagataccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 359 - DNA, 5781 bp, synthetic construct
  misc_feature 1..5781: note = synthetic sequence for use in compositions and/or methods
  source 1..5781: mol_type = other DNA
atgtcccctctggagatgtacaagaccgtgcccgtgtggaagcgcgagcctgtgcgggtgctgagcctcttcggcgacatcaaggccgagctggccagcctgggcttcctggaaagcggcagcggccctggcagactgaagcacctggacgacgtgaccaacacagtgcggaaggacgtggaacagtggggccctttcgacctggtctacggcgctacaccccccttcggccaggcctgcgacagaccccccggatggtatctgtttcagttccacagagtgctgcagtacgcccggcctggcggaccaagaccttttttctggatgttcgtggacaacctggttctgacagaagatgatagagccgtggcctctagattcctcgaggccgatcctgtcaccatcagagatgcctgtggcagagctctgcaagacgccgtgcacgtgtggtccaatatccctgctgtgcggagcagacattctgccctgctgcctcacgaggaactgtctctgctggctcgggacagacagcgggccagacaccccacccctggacctgccaggctggtgaaaaactgcttcctgccactgagagagtactttaaatacttcagcaccgagctgaccagcagcgtgggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtggccacaaatttcagcctgctgaagcaggccggcgacgtggaagagaatcctggccccagcgagctgatcaaagagaacatgcacatgaagctgtacatggaaggcaccgtggacaaccatcacttcaagtgcaccagcgagggcgagggcaagccctacgagggcacacagaccatgagaatcaaggtggtggaaggaggcccactgcccttcgccttcgacatcctggccaccagctttctgtacggctcaaagaccttcatcaaccacacccagggcatccctgatttcttcaagcagagcttccctgagggatttacctgggagagagtgacaacttatgaagatggcggagtgctgaccgccacacaagataccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 360 - DNA, 5790 bp, synthetic construct
  misc_feature 1..5790: note = synthetic sequence for use in compositions and/or methods
  source 1..5790: mol_type = other DNA
atgtcccctgtcgagatctacaagaccgtgtccgcctggaagcggcagcctgtgcgggtgctgagcctgttcggcaacatcgacaaggaactgaaaagcctgggattcctggaatctggcagcggctctgagggcggaacactgaagtacgtggaagatgtgaccaacgtggtgcggagagaggtggaaaagtggggcccttttgacctggtttacggcagcacccagcctctgggctacagctgcgacagatgccctggatggtacatgttccagttccacagaatcctgcaatacgccagacccagacaggattctcagcagccattcttctggatcttcgtggataacctgctgctgacagaggacgaccaggagacaaccgtgaggttcctgcagaccgaggctgtcaccctgcaggatgtgcggggcagagtgctgcagaacgccgtgcgggtgtggtccaacatccccggcctgaagagcaagcacgccgacctgacccctaaagaggaacagagcctcagaacacaagtgagaaccagaagcaagctggccgctcagaaagtggacagcctggtgaagtattgtctgctccccctgcgcgagtactttaagtacttcagccagaatagcctgcctctgggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtggccacaaatttcagcctgctgaagcaggccggcgacgtggaagagaatcctggccccagcgagctgatcaaagagaacatgcacatgaagctgtacatggaaggcaccgtggacaaccatcacttcaagtgcaccagcgagggcgagggcaagccctacgagggcacacagaccatgagaatcaaggtggtggaaggaggcccactgcccttcgccttcgacatcctggccaccagctttctgtacggctcaaagaccttcatcaaccacacccagggcatccctgatttcttcaagcagagcttccctgagggatttacctgggagagagtgacaacttatgaagatggcggagtgctgaccgccacacaagataccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 361 - DNA, 5784 bp, synthetic construct
  misc_feature 1..5784: note = synthetic sequence for use in compositions and/or methods
  source 1..5784: mol_type = other DNA
atgtcccctctggaaatgttcgagacactgcctgtgtggcggagacaacctgtgcgcgtgctggccctgttcggcgacatcaagaaagagctgaccagcctgggcttcctgggatctggaagcgaccagggcagactgaagcacctggacgacgtgaccgatgtggtgcggaaggacgtcgaggaatggggccccttcgacctgctgtacggcgccacccctgcccctggccacgcctgcgaccatcctccagcttggtatctgtttcagttccacaggctgctgcagtacgccagacccagcggcagccccagaccttttttctggatgttcgtggaccacctgatgctgaacaaggaagatcaggatctggtttgtagattcctcgagatggaacaggccaccatccccgatgtgcggggcggcgtgctgcaaagcgccgtgcgggtgtggtccaacatccctgctatccggagcagacactgggccctgccatctgaggaagagttgtctgtgctgacacagaatagacagagcagcaagctgcctgcccagagacctacaaagctgctgaaaaactgcttcctgcccctgagagagtactttaagtacttcagcacagagctgacctccagcaccggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtggccacaaatttcagcctgctgaagcaggccggcgacgtggaagagaatcctggccccagcgagctgatcaaagagaacatgcacatgaagctgtacatggaaggcaccgtggacaaccatcacttcaagtgcaccagcgagggcgagggcaagccctacgagggcacacagaccatgagaatcaaggtggtggaaggaggcccactgcccttcgccttcgacatcctggccaccagctttctgtacggctcaaagaccttcatcaaccacacccagggcatccctgatttcttcaagcagagcttccctgagggatttacctgggagagagtgacaacttatgaagatggcggagtgctgaccgccacacaagataccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 362 - DNA, 5778 bp, synthetic construct
  misc_feature 1..5778: note = synthetic sequence for use in compositions and/or methods
  source 1..5778: mol_type = other DNA
atgtccccactggagatgtacaagaccgtgcccgtgtggaaaagagaacctgtgcgggtgctgagcctgttcggcgacatcaagaaggaactgatgagccttggattcctcgagaacggcagcgaggccggaacaagaaggcatctggacgatgtgaccaacgtggtgcggagagaggtggaagattggggcccttttgatctggtctacggcagcacacctcctctgggcagagccttcgaccggcctccaggctggtatctgtttcagttccacagaatcctgcagtacgccagacccagacctggctctcagcagcctttcttctggatgttcgtggacaacctggtgctgagcgaggacgaccgggccgtggccaccagattcctggaaaccgaccccgtgacagtgcaggacgcccacggccggaccgtgcgcaacgccgtgcacgtgtggtctaatatccctgctgtgcggagcagacacagcgccgtcgtgtcccaggaggaactgtctctgctggcccaagatagacagccccccgcccagagccctgctgctctggttaagaactgcttcctgcctctgagagagtacttcaagtactttagcgccgagctgaccagctgtctgggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtggccacaaatttcagcctgctgaagcaggccggcgacgtggaagagaatcctggccccagcgagctgatcaaagagaacatgcacatgaagctgtacatggaaggcaccgtggacaaccatcacttcaagtgcaccagcgagggcgagggcaagccctacgagggcacacagaccatgagaatcaaggtggtggaaggaggcccactgcccttcgccttcgacatcctggccaccagctttctgtacggctcaaagaccttcatcaaccacacccagggcatccctgatttcttcaagcagagcttccctgagggatttacctgggagagagtgacaacttatgaagatggcggagtgctgaccgccacacaagataccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 363 - DNA, 5787 bp, synthetic construct
  misc_feature 1..5787: note = synthetic sequence for use in compositions and/or methods
  source 1..5787: mol_type = other DNA
atgaatcctctggaaacctacaagaccgtgcccgtgtggaagcgggaacccgtgcgggtgctgagcctgttcggcgacatccggagagaactggtgtccctgggcttcctcgagaacggcagcgcccctggaagactgaagcacctggacgatgtgaccgacgtggtgcggcgcgacgtcgagggctggggccccttcgacctggtgtacggcagcacccctccaatcggccacgcctgcgaccatcctcctgtgtggtatctgtttcagttccacagaatcctgcagtacgccagacctagacccggatctagacaaccttttttctggatgttcgtggacaacctgctgctgagccaggacgaccagacagccgctacaagattcctggaggccgatcctgtgaccatccaggatgtttgtggcagagccgtgcggaacgccgtgcacgtgtggtccaacatccccgctgtgcggtctagacacgccgccctggccagctgcgaggaactgtctctgctggcccaagataggcagagaaccaagcctccagctcagggccctgcccagctggtcaagaactgcttcctgcctcttagagagtactttaaatacttcagcacagagctgaccagcagcctgggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtggccacaaatttcagcctgctgaagcaggccggcgacgtggaagagaatcctggccccagcgagctgatcaaagagaacatgcacatgaagctgtacatggaaggcaccgtggacaaccatcacttcaagtgcaccagcgagggcgagggcaagccctacgagggcacacagaccatgagaatcaaggtggtggaaggaggcccactgcccttcgccttcgacatcctggccaccagctttctgtacggctcaaagaccttcatcaaccacacccagggcatccctgatttcttcaagcagagcttccctgagggatttacctgggagagagtgacaacttatgaagatggcggagtgctgaccgccacacaagataccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 364 - DNA, 5781 bp, synthetic construct
  misc_feature 1..5781: note = synthetic sequence for use in compositions and/or methods
  source 1..5781: mol_type = other DNA
atgagacctctggaaatgtacaagaccatgcctgagtggaagcggaaacctattcaggtgctgagcctgttcggcgatatcgaggaagagctggtgaagttcggattcctggaaaacagctccggcaatggcaatctgaagcacctggacgacgtgaccgacgtgctcagaaaagacgttgaagaatggggaccttttgacctgatctacggctctacacctccaatcggccagatcagcgagcacccccccgtgtggtatttcctgcagtactacagagtgctgcaatacggcaagcccaagatggattccgagaagccattcttctggatgttcgtggacagcctggtgctgaccaaggatgatcgggaaatcgccagcagattcctggagacagatcctgtgaccatctacgaggtgtgcgacgagatgatcaagaacgccgtcctggtgtggtccaacatccccagcatgaaaagcaacaacagcgccctgacatctgattgggacctgcctctggtcgcccaggacatccagagcctgaacgacttcagcctgtggcctgcttctctggtgaacaagtgctttaaccctcttaaagagtacttcaagtgtttttctaaggaccacaccagcggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtggccacaaatttcagcctgctgaagcaggccggcgacgtggaagagaatcctggccccagcgagctgatcaaagagaacatgcacatgaagctgtacatggaaggcaccgtggacaaccatcacttcaagtgcaccagcgagggcgagggcaagccctacgagggcacacagaccatgagaatcaaggtggtggaaggaggcccactgcccttcgccttcgacatcctggccaccagctttctgtacggctcaaagaccttcatcaaccacacccagggcatccctgatttcttcaagcagagcttccctgagggatttacctgggagagagtgacaacttatgaagatggcggagtgctgaccgccacacaagataccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 365 - DNA, 2694 bp, synthetic construct
  misc_feature 1..2694: note = synthetic sequence for use in compositions and/or methods
  source 1..2694: mol_type = other DNA
atggctcggaccaagcagaccgccagaaagagcaccggcggcggagcaagctctggcgccggatcaagttctggcggatctgcagccggcagcggatcatccggtgctagtggctcaagcggatccgccagtagcggcagcggctcaggcggtagcggaggacctatggaaatctacaagaccgtgtccgcttggaagcgccagcccgtgcgggtgctcagcctgtttagaaacatcgacaaggtgctgaaaagcctgggattcctggaatccggatctggcagcggcggcggcaccctgaagtacgtggaagatgtgacaaacgtggttaggcgggacgtcgagaagtggggcccttttgacctggtgtacggctccacccagcccctgggctccagctgtgaccggtgccccggctggtacatgttccagttccacagaatactgcagtacgccctgcctagacaggagagccagcggcctttcttctggatcttcatggacaacctgcttctgaccgaagatgatcaggagacaacaaccagattcctgcagaccgaagccgtgaccctgcaagacgtgcggggccgggactaccagaacgctatgagagtgtggtccaacatccccggcctgaagagcaagcacgcccccctgacccctaaagaagaagagtacctgcaggcccaagtgcggagcagaagcaagctggacgcccctaaggtggatctgctggtgaagaactgtctgctgcctctcagagagtactttaaatacttcagccagaacagcctccctctgggaggacctagcagcggcgccccacctccaagcggaggctctccagctggcagccctaccagcacagaggaaggcacaagcgagagcgccacacctgagagcggccctggcacctccaccgagcccagcgagggctctgcccctggcagccccgccggaagccccacctctacagaagaaggcaccagcacagagccttctgaaggctctgcccctggaacatccaccgagcctagcgagaagcggactgccgatggatctgagtttgagagccctaagaaaaaaagaaaggttggggtacccgccgctatggctgagaggcccttccagtgtcgaatctgcatgcgtaacttcagtcgctccgaccacctgtccgagcacatccgcacccacaccggcgagaagccttttgcctgtgacatttgtgggaggaaatttgccgcccgctccacccgcaccaaccataccaagatacacacgggcagccaaaagcccttccagtgtcgaatctgcatgcgtaacttcagtcgctccgacgacctgacccgccacatccgcacccacaccggcgagaagccttttgcctgtgacatttgtgggaggaaatttgcccagtcctccgacctgcgccgccataccaagatacacacgggatctcagaagcccttccagtgtcgaatctgcatgcgtaacttcagtcagtccggctccctgacccgccacatccgcacccacaccggcgagaagccttttgcctgtgacatttgtgggaggaaatttgccgaccgctcccacctggcccgccataccaagatacacctgcgccaaaaagatgcggcccggggatccaagaggaccgccgacggcagcgagttcgagcccaagaaaaagcggaaggtgtccggctctgaaacccctggcacaagcgagtctgctacacctgagtccagaaccctggtcaccttcaaagacgtgttcgtggacttcaccagagaagaatggaagctgctggataccgctcagcagatcgtgtacagaaacgtgatgctggaaaactacaagaatctggtgtccctgggctaccagctgaccaagcctgacgtgatcctgagactggaaaagggcgaggaacccgctacaaacttcagcctgctgaaacaggccggcgacgtcgaggaaaatcctggccccagcgagctgattaaggaaaacatgcacatgaagctgtatatggaaggcaccgtggacaaccaccatttcaagtgcaccagcgagggcgaaggcaagccctacgagggaacacagaccatgcggatcaaggtggtggaaggcggccctctgcccttcgccttcgacatcctcgccacctctttcctgtacggcagtaagacctttatcaaccacacccagggcatccccgatttcttcaagcagagcttccccgagggatttacctgggagagagtgaccacctacgaggacggcggcgtgctgacagccacccaggacaccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 366 - DNA, 2463 bp, synthetic construct
  misc_feature 1..2463: note = synthetic sequence for use in compositions and/or methods
  source 1..2463: mol_type = other DNA
atggctcggaccaagcagaccgccagaaagagcaccggcggcggagcaagctctggcgccggatcaagttctggcggatctgcagccggcagcggatcatccggtgctagtggctcaagcggatccgccagtagcggcagcggctcaggcggtagcggaggacctatggaaatctacaagaccgtgtccgcttggaagcgccagcccgtgcgggtgctcagcctgtttagaaacatcgacaaggtgctgaaaagcctgggattcctggaatccggatctggcagcggcggcggcaccctgaagtacgtggaagatgtgacaaacgtggttaggcgggacgtcgagaagtggggcccttttgacctggtgtacggctccacccagcccctgggctccagctgtgaccggtgccccggctggtacatgttccagttccacagaatactgcagtacgccctgcctagacaggagagccagcggcctttcttctggatcttcatggacaacctgcttctgaccgaagatgatcaggagacaacaaccagattcctgcagaccgaagccgtgaccctgcaagacgtgcggggccgggactaccagaacgctatgagagtgtggtccaacatccccggcctgaagagcaagcacgcccccctgacccctaaagaagaagagtacctgcaggcccaagtgcggagcagaagcaagctggacgcccctaaggtggatctgctggtgaagaactgtctgctgcctctcagagagtactttaaatacttcagccagaacagcctccctctgggaggacctagcagcggcgccccacctccaagcggaggctctccagctggcagccctaccagcacagaggaaggcacaagcgagagcgccacacctgagagcggccctggcacctccaccgagcccagcgagggctctgcccctggcagccccgccggaagccccacctctacagaagaaggcaccagcacagagccttctgaaggctctgcccctggaacatccaccgagcctagcgagaagcggactgccgatggatctgagtttgagagccctaagaaaaaaagaaaggttgggggggtacccgccgctatggctgagaggcccttccagtgtcgaatctgcatgcgtaacttcagtcgctccgaccacctgtccgagcacatccgcacccacaccggcgagaagccttttgcctgtgacatttgtgggaggaaatttgccgcccgctccacccgcaccaaccataccaagatacacacgggcagccaaaagcccttccagtgtcgaatctgcatgcgtaacttcagtcgctccgacgacctgacccgccacatccgcacccacaccggcgagaagccttttgcctgtgacatttgtgggaggaaatttgcccagtcctccgacctgcgccgccataccaagatacacacgggatctcagaagcccttccagtgtcgaatctgcatgcgtaacttcagtcagtccggctccctgacccgccacatccgcacccacaccggcgagaagccttttgcctgtgacatttgtgggaggaaatttgccgaccgctcccacctggcccgccataccaagatacacctgcgccaaaaagatgcggcccggggatccaagaggaccgccgacggcagcgagttcgagcccaagaaaaagcggaaggtggctacaaacttcagcctgctgaaacaggccggcgacgtcgaggaaaatcctggccccagcgagctgattaaggaaaacatgcacatgaagctgtatatggaaggcaccgtggacaaccaccatttcaagtgcaccagcgagggcgaaggcaagccctacgagggaacacagaccatgcggatcaaggtggtggaaggcggccctctgcccttcgccttcgacatcctcgccacctctttcctgtacggcagtaagacctttatcaaccacacccagggcatccccgatttcttcaagcagagcttccccgagggatttacctgggagagagtgaccacctacgaggacggcggcgtgctgacagccacccaggacaccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 367 - DNA, 5943 bp, synthetic construct
  misc_feature 1..5943: note = synthetic sequence for use in compositions and/or methods
  source 1..5943: mol_type = other DNA
atggctcggaccaagcagaccgccagaaagagcaccggcggcggagcaagctctggcgccggatcaagttctggcggatctgcagccggcagcggatcatccggtgctagtggctcaagcggatccgccagtagcggcagcggctcaggcggtagcggatcccctgttgagatctacaagaccgtgtccgcctggaagcggcagccaatcagagtgctgagcctgttcggcaatattgacaaggaactgaagtctctgggcttcctggaaagcggcagccacagcgagggcggcacactgaagtacgtggaagatgtgaccaacgtggtgcggagagatgtggaaaagtggggacctttcgacctgctgtacggcagcacccagcctctgggcggaagctgcgacaggtgtcctggctggtacatgttccaatttcatagaatcctgcagtacgccagacctagacaggagtctcagcccttcttctggatcttcatggataacctgctgctcacagaggacgaccagatgaccaccgtgcggttcctgcaaacagaggccgtcaccctgcgcgacgtgagatctagagtgctgcagaacgccgtccgggtgtggagcaacatccccggtcttaaaagcaagcacgaggctctgtccccaaaagaggaagagagcctgcagggccacgtgcggaccagatctaagctggccgctcctaaagtggaccccctggtgaagaactgcctgctgcctctgagagagtactttaagtatttcagccagagcagcctgcccctgggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtggccacaaatttcagcctgctgaagcaggccggcgacgtggaagagaatcctggccccagcgagctgatcaaagagaacatgcacatgaagctgtacatggaaggcaccgtggacaaccatcacttcaagtgcaccagcgagggcgagggcaagccctacgagggcacacagaccatgagaatcaaggtggtggaaggaggcccactgcccttcgccttcgacatcctggccaccagctttctgtacggctcaaagaccttcatcaaccacacccagggcatccctgatttcttcaagcagagcttccctgagggatttacctgggagagagtgacaacttatgaagatggcggagtgctgaccgccacacaagataccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 368 - DNA, 6177 bp, synthetic construct
  misc_feature 1..6177: note = synthetic sequence for use in compositions and/or methods
  source 1..6177: mol_type = other DNA
atggctcggaccaagcagaccgccagaaagagcaccggcggcggagcaagctctggcgccggatcaagttctggcggatctgcagccggcagcggatcatccggtgctagtggctcaagcggatccgccagtagcggcagcggctcaggcggtagcggatcccctgttgagatctacaagaccgtgtccgcctggaagcggcagccaatcagagtgctgagcctgttcggcaatattgacaaggaactgaagtctctgggcttcctggaaagcggcagccacagcgagggcggcacactgaagtacgtggaagatgtgaccaacgtggtgcggagagatgtggaaaagtggggacctttcgacctgctgtacggcagcacccagcctctgggcggaagctgcgacaggtgtcctggctggtacatgttccaatttcatagaatcctgcagtacgccagacctagacaggagtctcagcccttcttctggatcttcatggataacctgctgctcacagaggacgaccagatgaccaccgtgcggttcctgcaaacagaggccgtcaccctgcgcgacgtgagatctagagtgctgcagaacgccgtccgggtgtggagcaacatccccggtcttaaaagcaagcacgaggctctgtccccaaaagaggaagagagcctgcagggccacgtgcggaccagatctaagctggccgctcctaaagtggaccccctggtgaagaactgcctgctgcctctgagagagtactttaagtatttcagccagagcagcctgcccctgggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtgtccggctctgaaacccctggaacctccgagagcgccacacctgaaagcagaaccctggtgaccttcaaggacgtgttcgtggacttcacccgcgaggaatggaagctcctggacaccgcccagcaaatcgtgtaccggaacgtgatgctggagaattacaagaacctggtgtctctgggctaccagctgacgaagcctgacgtcatcctgagactggaaaagggagaggagcctgccacaaatttcagcctgctgaagcaggccggcgacgtggaagagaatcctggccccagcgagctgatcaaagagaacatgcacatgaagctgtacatggaaggcaccgtggacaaccatcacttcaagtgcaccagcgagggcgagggcaagccctacgagggcacacagaccatgagaatcaaggtggtggaaggaggcccactgcccttcgccttcgacatcctggccaccagctttctgtacggctcaaagaccttcatcaaccacacccagggcatccctgatttcttcaagcagagcttccctgagggatttacctgggagagagtgacaacttatgaagatggcggagtgctgaccgccacacaagataccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 369 - DNA, 2691 bp, synthetic construct
  misc_feature 1..2691: note = synthetic sequence for use in compositions and/or methods
  source 1..2691: mol_type = other DNA
atggctcggaccaagcagaccgccagaaagagcaccggcggcggagcaagctctggcgccggatcaagttctggcggatctgcagccggcagcggatcatccggtgctagtggctcaagcggatccgccagtagcggcagcggctcaggcggtagcggatcccctgttgagatctacaagaccgtgtccgcctggaagcggcagccaatcagagtgctgagcctgttcggcaatattgacaaggaactgaagtctctgggcttcctggaaagcggcagccacagcgagggcggcacactgaagtacgtggaagatgtgaccaacgtggtgcggagagatgtggaaaagtggggacctttcgacctgctgtacggcagcacccagcctctgggcggaagctgcgacaggtgtcctggctggtacatgttccaatttcatagaatcctgcagtacgccagacctagacaggagtctcagcccttcttctggatcttcatggataacctgctgctcacagaggacgaccagatgaccaccgtgcggttcctgcaaacagaggccgtcaccctgcgcgacgtgagatctagagtgctgcagaacgccgtccgggtgtggagcaacatccccggtcttaaaagcaagcacgaggctctgtccccaaaagaggaagagagcctgcagggccacgtgcggaccagatctaagctggccgctcctaaagtggaccccctggtgaagaactgcctgctgcctctgagagagtactttaagtatttcagccagagcagcctgcccctgggaggacctagcagcggcgccccacctccaagcggaggctctccagctggcagccctaccagcacagaggaaggcacaagcgagagcgccacacctgagagcggccctggcacctccaccgagcccagcgagggctctgcccctggcagccccgccggaagccccacctctacagaagaaggcaccagcacagagccttctgaaggctctgcccctggaacatccaccgagcctagcgagaagcggactgccgatggatctgagtttgagagccctaagaaaaaaagaaaggttggggtacccgccgctatggctgagaggcccttccagtgtcgaatctgcatgcgtaacttcagtcgctccgaccacctgtccgagcacatccgcacccacaccggcgagaagccttttgcctgtgacatttgtgggaggaaatttgccgcccgctccacccgcaccaaccataccaagatacacacgggcagccaaaagcccttccagtgtcgaatctgcatgcgtaacttcagtcgctccgacgacctgacccgccacatccgcacccacaccggcgagaagccttttgcctgtgacatttgtgggaggaaatttgcccagtcctccgacctgcgccgccataccaagatacacacgggatctcagaagcccttccagtgtcgaatctgcatgcgtaacttcagtcagtccggctccctgacccgccacatccgcacccacaccggcgagaagccttttgcctgtgacatttgtgggaggaaatttgccgaccgctcccacctggcccgccataccaagatacacctgcgccaaaaagatgcggcccggggatccaagaggaccgccgacggcagcgagttcgagcccaagaaaaagcggaaggtgtccggctctgaaacccctggcacaagcgagtctgctacacctgagtccagaaccctggtcaccttcaaagacgtgttcgtggacttcaccagagaagaatggaagctgctggataccgctcagcagatcgtgtacagaaacgtgatgctggaaaactacaagaatctggtgtccctgggctaccagctgaccaagcctgacgtgatcctgagactggaaaagggcgaggaacccgctacaaacttcagcctgctgaaacaggccggcgacgtcgaggaaaatcctggccccagcgagctgattaaggaaaacatgcacatgaagctgtatatggaaggcaccgtggacaaccaccatttcaagtgcaccagcgagggcgaaggcaagccctacgagggaacacagaccatgcggatcaaggtggtggaaggcggccctctgcccttcgccttcgacatcctcgccacctctttcctgtacggcagtaagacctttatcaaccacacccagggcatccccgatttcttcaagcagagcttccccgagggatttacctgggagagagtgaccacctacgaggacggcggcgtgctgacagccacccaggacaccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 370 - DNA, 2748 bp, synthetic construct
  misc_feature 1..2748: note = synthetic sequence for use in compositions and/or methods
  source 1..2748: mol_type = other DNA
atggctacaaacttcagcctgctgaaacaggccggcgacgtcgaggaaaatcctggccccgctcggaccaagcagaccgccagaaagagcaccggcggcggagcaagctctggcgccggatcaagttctggcggatctgcagccggcagcggatcatccggtgctagtggctcaagcggatccgccagtagcggcagcggctcaggcggtagcggatcccctgttgagatctacaagaccgtgtccgcctggaagcggcagccaatcagagtgctgagcctgttcggcaatattgacaaggaactgaagtctctgggcttcctggaaagcggcagccacagcgagggcggcacactgaagtacgtggaagatgtgaccaacgtggtgcggagagatgtggaaaagtggggacctttcgacctgctgtacggcagcacccagcctctgggcggaagctgcgacaggtgtcctggctggtacatgttccaatttcatagaatcctgcagtacgccagacctagacaggagtctcagcccttcttctggatcttcatggataacctgctgctcacagaggacgaccagatgaccaccgtgcggttcctgcaaacagaggccgtcaccctgcgcgacgtgagatctagagtgctgcagaacgccgtccgggtgtggagcaacatccccggtcttaaaagcaagcacgaggctctgtccccaaaagaggaagagagcctgcagggccacgtgcggaccagatctaagctggccgctcctaaagtggaccccctggtgaagaactgcctgctgcctctgagagagtactttaagtatttcagccagagcagcctgcccctgggaggacctagcagcggcgccccacctccaagcggaggctctccagctggcagccctaccagcacagaggaaggcacaagcgagagcgccacacctgagagcggccctggcacctccaccgagcccagcgagggctctgcccctggcagccccgccggaagccccacctctacagaagaaggcaccagcacagagccttctgaaggctctgcccctggaacatccaccgagcctagcgagaagcggactgccgatggatctgagtttgagagccctaagaaaaaaagaaaggttggggtacccgccgctatggctgagaggcccttccagtgtcgaatctgcatgcgtaacttcagtcgctccgaccacctgtccgagcacatccgcacccacaccggcgagaagccttttgcctgtgacatttgtgggaggaaatttgccgcccgctccacccgcaccaaccataccaagatacacacgggcagccaaaagcccttccagtgtcgaatctgcatgcgtaacttcagtcgctccgacgacctgacccgccacatccgcacccacaccggcgagaagccttttgcctgtgacatttgtgggaggaaatttgcccagtcctccgacctgcgccgccataccaagatacacacgggatctcagaagcccttccagtgtcgaatctgcatgcgtaacttcagtcagtccggctccctgacccgccacatccgcacccacaccggcgagaagccttttgcctgtgacatttgtgggaggaaatttgccgaccgctcccacctggcccgccataccaagatacacctgcgccaaaaagatgcggcccggggatccaagaggaccgccgacggcagcgagttcgagcccaagaaaaagcggaaggtgtccggctctgaaacccctggcacaagcgagtctgctacacctgagtccagaaccctggtcaccttcaaagacgtgttcgtggacttcaccagagaagaatggaagctgctggataccgctcagcagatcgtgtacagaaacgtgatgctggaaaactacaagaatctggtgtccctgggctaccagctgaccaagcctgacgtgatcctgagactggaaaagggcgaggaacccgctacaaacttcagcctgctgaaacaggccggcgacgtcgaggaaaatcctggccccagcgagctgattaaggaaaacatgcacatgaagctgtatatggaaggcaccgtggacaaccaccatttcaagtgcaccagcgagggcgaaggcaagccctacgagggaacacagaccatgcggatcaaggtggtggaaggcggccctctgcccttcgccttcgacatcctcgccacctctttcctgtacggcagtaagacctttatcaaccacacccagggcatccccgatttcttcaagcagagcttccccgagggatttacctgggagagagtgaccacctacgaggacggcggcgtgctgacagccacccaggacaccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 371 - DNA, 2754 bp, synthetic construct
  misc_feature 1..2754: note = synthetic sequence for use in compositions and/or methods
  source 1..2754: mol_type = other DNA
atgggatctggcgagggcagaggcagcctgctgacctgcggcgacgtggaagagaaccccggccctgctcggaccaagcagaccgccagaaagagcaccggcggcggagcaagctctggcgccggatcaagttctggcggatctgcagccggcagcggatcatccggtgctagtggctcaagcggatccgccagtagcggcagcggctcaggcggtagcggatcccctgttgagatctacaagaccgtgtccgcctggaagcggcagccaatcagagtgctgagcctgttcggcaatattgacaaggaactgaagtctctgggcttcctggaaagcggcagccacagcgagggcggcacactgaagtacgtggaagatgtgaccaacgtggtgcggagagatgtggaaaagtggggacctttcgacctgctgtacggcagcacccagcctctgggcggaagctgcgacaggtgtcctggctggtacatgttccaatttcatagaatcctgcagtacgccagacctagacaggagtctcagcccttcttctggatcttcatggataacctgctgctcacagaggacgaccagatgaccaccgtgcggttcctgcaaacagaggccgtcaccctgcgcgacgtgagatctagagtgctgcagaacgccgtccgggtgtggagcaacatccccggtcttaaaagcaagcacgaggctctgtccccaaaagaggaagagagcctgcagggccacgtgcggaccagatctaagctggccgctcctaaagtggaccccctggtgaagaactgcctgctgcctctgagagagtactttaagtatttcagccagagcagcctgcccctgggaggacctagcagcggcgccccacctccaagcggaggctctccagctggcagccctaccagcacagaggaaggcacaagcgagagcgccacacctgagagcggccctggcacctccaccgagcccagcgagggctctgcccctggcagccccgccggaagccccacctctacagaagaaggcaccagcacagagccttctgaaggctctgcccctggaacatccaccgagcctagcgagaagcggactgccgatggatctgagtttgagagccctaagaaaaaaagaaaggttggggtacccgccgctatggctgagaggcccttccagtgtcgaatctgcatgcgtaacttcagtcgctccgaccacctgtccgagcacatccgcacccacaccggcgagaagccttttgcctgtgacatttgtgggaggaaatttgccgcccgctccacccgcaccaaccataccaagatacacacgggcagccaaaagcccttccagtgtcgaatctgcatgcgtaacttcagtcgctccgacgacctgacccgccacatccgcacccacaccggcgagaagccttttgcctgtgacatttgtgggaggaaatttgcccagtcctccgacctgcgccgccataccaagatacacacgggatctcagaagcccttccagtgtcgaatctgcatgcgtaacttcagtcagtccggctccctgacccgccacatccgcacccacaccggcgagaagccttttgcctgtgacatttgtgggaggaaatttgccgaccgctcccacctggcccgccataccaagatacacctgcgccaaaaagatgcggcccggggatccaagaggaccgccgacggcagcgagttcgagcccaagaaaaagcggaaggtgtccggctctgaaacccctggcacaagcgagtctgctacacctgagtccagaaccctggtcaccttcaaagacgtgttcgtggacttcaccagagaagaatggaagctgctggataccgctcagcagatcgtgtacagaaacgtgatgctggaaaactacaagaatctggtgtccctgggctaccagctgaccaagcctgacgtgatcctgagactggaaaagggcgaggaacccgctacaaacttcagcctgctgaaacaggccggcgacgtcgaggaaaatcctggccccagcgagctgattaaggaaaacatgcacatgaagctgtatatggaaggcaccgtggacaaccaccatttcaagtgcaccagcgagggcgaaggcaagccctacgagggaacacagaccatgcggatcaaggtggtggaaggcggccctctgcccttcgccttcgacatcctcgccacctctttcctgtacggcagtaagacctttatcaaccacacccagggcatccccgatttcttcaagcagagcttccccgagggatttacctgggagagagtgaccacctacgaggacggcggcgtgctgacagccacccaggacaccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 372 - DNA, 2691 bp, synthetic construct
  misc_feature 1..2691: note = synthetic sequence for use in compositions and/or methods
  source 1..2691: mol_type = other DNA
atggctcggaccgcacagaccgccagaaagagcaccggcggcggagcaagctctggcgccggatcaagttctggcggatctgcagccggcagcggatcatccggtgctagtggctcaagcggatccgccagtagcggcagcggctcaggcggtagcggatcccctgttgagatctacaagaccgtgtccgcctggaagcggcagccaatcagagtgctgagcctgttcggcaatattgacaaggaactgaagtctctgggcttcctggaaagcggcagccacagcgagggcggcacactgaagtacgtggaagatgtgaccaacgtggtgcggagagatgtggaaaagtggggacctttcgacctgctgtacggcagcacccagcctctgggcggaagctgcgacaggtgtcctggctggtacatgttccaatttcatagaatcctgcagtacgccagacctagacaggagtctcagcccttcttctggatcttcatggataacctgctgctcacagaggacgaccagatgaccaccgtgcggttcctgcaaacagaggccgtcaccctgcgcgacgtgagatctagagtgctgcagaacgccgtccgggtgtggagcaacatccccggtcttaaaagcaagcacgaggctctgtccccaaaagaggaagagagcctgcagggccacgtgcggaccagatctaagctggccgctcctaaagtggaccccctggtgaagaactgcctgctgcctctgagagagtactttaagtatttcagccagagcagcctgcccctgggaggacctagcagcggcgccccacctccaagcggaggctctccagctggcagccctaccagcacagaggaaggcacaagcgagagcgccacacctgagagcggccctggcacctccaccgagcccagcgagggctctgcccctggcagccccgccggaagccccacctctacagaagaaggcaccagcacagagccttctgaaggctctgcccctggaacatccaccgagcctagcgagaagcggactgccgatggatctgagtttgagagccctaagaaaaaaagaaaggttggggtacccgccgctatggctgagaggcccttccagtgtcgaatctgcatgcgtaacttcagtcgctccgaccacctgtccgagcacatccgcacccacaccggcgagaagccttttgcctgtgacatttgtgggaggaaatttgccgcccgctccacccgcaccaaccataccaagatacacacgggcagccaaaagcccttccagtgtcgaatctgcatgcgtaacttcagtcgctccgacgacctgacccgccacatccgcacccacaccggcgagaagccttttgcctgtgacatttgtgggaggaaatttgcccagtcctccgacctgcgccgccataccaagatacacacgggatctcagaagcccttccagtgtcgaatctgcatgcgtaacttcagtcagtccggctccctgacccgccacatccgcacccacaccggcgagaagccttttgcctgtgacatttgtgggaggaaatttgccgaccgctcccacctggcccgccataccaagatacacctgcgccaaaaagatgcggcccggggatccaagaggaccgccgacggcagcgagttcgagcccaagaaaaagcggaaggtgtccggctctgaaacccctggcacaagcgagtctgctacacctgagtccagaaccctggtcaccttcaaagacgtgttcgtggacttcaccagagaagaatggaagctgctggataccgctcagcagatcgtgtacagaaacgtgatgctggaaaactacaagaatctggtgtccctgggctaccagctgaccaagcctgacgtgatcctgagactggaaaagggcgaggaacccgctacaaacttcagcctgctgaaacaggccggcgacgtcgaggaaaatcctggccccagcgagctgattaaggaaaacatgcacatgaagctgtatatggaaggcaccgtggacaaccaccatttcaagtgcaccagcgagggcgaaggcaagccctacgagggaacacagaccatgcggatcaaggtggtggaaggcggccctctgcccttcgccttcgacatcctcgccacctctttcctgtacggcagtaagacctttatcaaccacacccagggcatccccgatttcttcaagcagagcttccccgagggatttacctgggagagagtgaccacctacgaggacggcggcgtgctgacagccacccaggacaccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 373 - DNA, 2535 bp, synthetic construct
  misc_feature 1..2535: note = synthetic sequence for use in compositions and/or methods
  source 1..2535: mol_type = other DNA
atgtcccctgttgagatctacaagaccgtgtccgcctggaagcggcagccaatcagagtgctgagcctgttcggcaatattgacaaggaactgaagtctctgggcttcctggaaagcggcagccacagcgagggcggcacactgaagtacgtggaagatgtgaccaacgtggtgcggagagatgtggaaaagtggggacctttcgacctgctgtacggcagcacccagcctctgggcggaagctgcgacaggtgtcctggctggtacatgttccaatttcatagaatcctgcagtacgccagacctagacaggagtctcagcccttcttctggatcttcatggataacctgctgctcacagaggacgaccagatgaccaccgtgcggttcctgcaaacagaggccgtcaccctgcgcgacgtgagatctagagtgctgcagaacgccgtccgggtgtggagcaacatccccggtcttaaaagcaagcacgaggctctgtccccaaaagaggaagagagcctgcagggccacgtgcggaccagatctaagctggccgctcctaaagtggaccccctggtgaagaactgcctgctgcctctgagagagtactttaagtatttcagccagagcagcctgcccctgggaggacctagcagcggcgccccacctccaagcggaggctctccagctggcagccctaccagcacagaggaaggcacaagcgagagcgccacacctgagagcggccctggcacctccaccgagcccagcgagggctctgcccctggcagccccgccggaagccccacctctacagaagaaggcaccagcacagagccttctgaaggctctgcccctggaacatccaccgagcctagcgagaagcggactgccgatggatctgagtttgagagccctaagaaaaaaagaaaggttggggtacccgccgctatggctgagaggcccttccagtgtcgaatctgcatgcgtaacttcagtcgctccgaccacctgtccgagcacatccgcacccacaccggcgagaagccttttgcctgtgacatttgtgggaggaaatttgccgcccgctccacccgcaccaaccataccaagatacacacgggcagccaaaagcccttccagtgtcgaatctgcatgcgtaacttcagtcgctccgacgacctgacccgccacatccgcacccacaccggcgagaagccttttgcctgtgacatttgtgggaggaaatttgcccagtcctccgacctgcgccgccataccaagatacacacgggatctcagaagcccttccagtgtcgaatctgcatgcgtaacttcagtcagtccggctccctgacccgccacatccgcacccacaccggcgagaagccttttgcctgtgacatttgtgggaggaaatttgccgaccgctcccacctggcccgccataccaagatacacctgcgccaaaaagatgcggcccggggatccaagaggaccgccgacggcagcgagttcgagcccaagaaaaagcggaaggtgtccggctctgaaacccctggcacaagcgagtctgctacacctgagtccagaaccctggtcaccttcaaagacgtgttcgtggacttcaccagagaagaatggaagctgctggataccgctcagcagatcgtgtacagaaacgtgatgctggaaaactacaagaatctggtgtccctgggctaccagctgaccaagcctgacgtgatcctgagactggaaaagggcgaggaacccgctacaaacttcagcctgctgaaacaggccggcgacgtcgaggaaaatcctggccccagcgagctgattaaggaaaacatgcacatgaagctgtatatggaaggcaccgtggacaaccaccatttcaagtgcaccagcgagggcgaaggcaagccctacgagggaacacagaccatgcggatcaaggtggtggaaggcggccctctgcccttcgccttcgacatcctcgccacctctttcctgtacggcagtaagacctttatcaaccacacccagggcatccccgatttcttcaagcagagcttccccgagggatttacctgggagagagtgaccacctacgaggacggcggcgtgctgacagccacccaggacaccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 374 - DNA, 2730 bp, synthetic construct
  misc_feature 1..2730: note = synthetic sequence for use in compositions and/or methods
  source 1..2730: mol_type = other DNA
atggctcggaccaagcagaccgccagaaagagcaccggcggcggagcaagctctggcgccggatcaagttctggcggatctgcagccggcagcggatcatccggtgctagtggctcaagcggatccgccagtagcggcagcggctcaggcggtagcggatcccctgttgagatctacaagaccgtgtccgcctggaagcggcagccaatcagagtgctgagcctgttcggcaatattgacaaggaactgaagtctctgggcttcctggaaagcggcagccacagcgagggcggcacactgaagtacgtggaagatgtgaccaacgtggtgcggagagatgtggaaaagtggggacctttcgacctgctgtacggcagcacccagcctctgggcggaagctgcgacaggtgtcctggctggtacatgttccaatttcatagaatcctgcagtacgccagacctagacaggagtctcagcccttcttctggatcttcatggataacctgctgctcacagaggacgaccagatgaccaccgtgcggttcctgcaaacagaggccgtcaccctgcgcgacgtgagatctagagtgctgcagaacgccgtccgggtgtggagcaacatccccggtcttaaaagcaagcacgaggctctgtccccaaaagaggaagagagcctgcagggccacgtgcggaccagatctaagctggccgctcctaaagtggaccccctggtgaagaactgcctgctgcctctgagagagtactttaagtatttcagccagagcagcctgcccctgggaggacctagcagcggcgccccacctccaagcggaggctctccagctggcagccctaccagcacagaggaaggcacaagcgagagcgccacacctgagagcggccctggcacctccaccgagcccagcgagggctctgcccctggcagccccgccggaagccccacctctacagaagaaggcaccagcacagagccttctgaaggctctgcccctggaacatccaccgagcctagcgagaagcggactgccgatggatctgagtttgagagccctaagaaaaaaagaaaggttgggggagtgcccgccgccatggccgaacggcctttccagtgcagaatctgcatgaacttcagctacaagtgctgcctgtctgatcacatccggacccacaccggcgagaaaccttttgcctgtgacatctgcggaagaaagttcgcccggagcgctaatctgaccagacataccaagatccacacaggcagccagaaacctttccagtgccggatctgtatgaacttctctagaagcgaccacctgagcgcccacatcagaacacatacaggcgagaagccattcgcttgcgacatctgcggcagaaagtttgctgatagatctgccctggcccggcacaccaagatccacacccaccccagagcccctatccccaagcctttccaatgtcggatctgcatgaacttcagcatcaagcacgacctgcacagacacattcgcacccacaccggcgaaaaaccttttgcctgcgacatctgtggcagaaagttcgccaggtccgccaacctgacaagacacacaaagatccacctgagacagaaggacgccgctagaggcagcggcggagatgccaagagcctgaccgcctggtccaagaggaccgccgacggcagcgagttcgagcccaagaaaaagcggaaggtgtccggctctgaaacccctggcacaagcgagtctgctacacctgagtccagaaccctggtcaccttcaaagacgtgttcgtggacttcaccagagaagaatggaagctgctggataccgctcagcagatcgtgtacagaaacgtgatgctggaaaactacaagaatctggtgtccctgggctaccagctgaccaagcctgacgtgatcctgagactggaaaagggcgaggaacccgctacaaacttcagcctgctgaaacaggccggcgacgtcgaggaaaatcctggccccagcgagctgattaaggaaaacatgcacatgaagctgtatatggaaggcaccgtggacaaccaccatttcaagtgcaccagcgagggcgaaggcaagccctacgagggaacacagaccatgcggatcaaggtggtggaaggcggccctctgcccttcgccttcgacatcctcgccacctctttcctgtacggcagtaagacctttatcaaccacacccagggcatccccgatttcttcaagcagagcttccccgagggatttacctgggagagagtgaccacctacgaggacggcggcgtgctgacagccacccaggacaccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 375 - DNA, 2724 bp, synthetic construct
  misc_feature 1..2724: note = synthetic sequence for use in compositions and/or methods
  source 1..2724: mol_type = other DNA
atggctcggaccaagcagaccgccagaaagagcaccggcggcggagcaagctctggcgccggatcaagttctggcggatctgcagccggcagcggatcatccggtgctagtggctcaagcggatccgccagtagcggcagcggctcaggcggtagcggatcccctgttgagatctacaagaccgtgtccgcctggaagcggcagccaatcagagtgctgagcctgttcggcaatattgacaaggaactgaagtctctgggcttcctggaaagcggcagccacagcgagggcggcacactgaagtacgtggaagatgtgaccaacgtggtgcggagagatgtggaaaagtggggacctttcgacctgctgtacggcagcacccagcctctgggcggaagctgcgacaggtgtcctggctggtacatgttccaatttcatagaatcctgcagtacgccagacctagacaggagtctcagcccttcttctggatcttcatggataacctgctgctcacagaggacgaccagatgaccaccgtgcggttcctgcaaacagaggccgtcaccctgcgcgacgtgagatctagagtgctgcagaacgccgtccgggtgtggagcaacatccccggtcttaaaagcaagcacgaggctctgtccccaaaagaggaagagagcctgcagggccacgtgcggaccagatctaagctggccgctcctaaagtggaccccctggtgaagaactgcctgctgcctctgagagagtactttaagtatttcagccagagcagcctgcccctgggaggacctagcagcggcgccccacctccaagcggaggctctccagctggcagccctaccagcacagaggaaggcacaagcgagagcgccacacctgagagcggccctggcacctccaccgagcccagcgagggctctgcccctggcagccccgccggaagccccacctctacagaagaaggcaccagcacagagccttctgaaggctctgcccctggaacatccaccgagcctagcgagaagcggactgccgatggatctgagtttgagagccctaagaaaaaaagaaaggttgggggagtgcctgctgctatggccgagcggcctttccagtgtcggatctgtatgcaaaatttcagctaccccaaggacctggccagacacatccggacacacaccggcgaaaagccttttgcctgcgacatctgcggccgcaaattcgctacaagcggcaacctgacaagacatacaaaaatccacaccggctctcaaaagcctttccagtgcaggatctgcatgcagaacttctccaccagcggatctctgagcagacacattagaacccataccggcgagaagccattcgcctgtgacatctgcggcagaaagttcgcccagagcgccgatagaacaaagcacacaaagatccacaccggcagccagaaaccttttcagtgcagaatctgcatgaacttcagccagagcggcgatctgaccagacacatcagaacccacaccggagaaaagccctttgcctgcgatatctgtggccggaagttcgcctaccggtggctgcggaacaaccacaccaagatccacctgagacagaaggacgccgccagaggctctggcggcgacgccaagagcctgaccgcctggtccaagaggaccgccgacggcagcgagttcgagcccaagaaaaagcggaaggtgtccggctctgaaacccctggcacaagcgagtctgctacacctgagtccagaaccctggtcaccttcaaagacgtgttcgtggacttcaccagagaagaatggaagctgctggataccgctcagcagatcgtgtacagaaacgtgatgctggaaaactacaagaatctggtgtccctgggctaccagctgaccaagcctgacgtgatcctgagactggaaaagggcgaggaacccgctacaaacttcagcctgctgaaacaggccggcgacgtcgaggaaaatcctggccccagcgagctgattaaggaaaacatgcacatgaagctgtatatggaaggcaccgtggacaaccaccatttcaagtgcaccagcgagggcgaaggcaagccctacgagggaacacagaccatgcggatcaaggtggtggaaggcggccctctgcccttcgccttcgacatcctcgccacctctttcctgtacggcagtaagacctttatcaaccacacccagggcatccccgatttcttcaagcagagcttccccgagggatttacctgggagagagtgaccacctacgaggacggcggcgtgctgacagccacccaggacaccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 376 - DNA, 2730 bp, synthetic construct
  misc_feature 1..2730: note = synthetic sequence for use in compositions and/or methods
  source 1..2730: mol_type = other DNA
atggctcggaccaagcagaccgccagaaagagcaccggcggcggagcaagctctggcgccggatcaagttctggcggatctgcagccggcagcggatcatccggtgctagtggctcaagcggatccgccagtagcggcagcggctcaggcggtagcggatcccctgttgagatctacaagaccgtgtccgcctggaagcggcagccaatcagagtgctgagcctgttcggcaatattgacaaggaactgaagtctctgggcttcctggaaagcggcagccacagcgagggcggcacactgaagtacgtggaagatgtgaccaacgtggtgcggagagatgtggaaaagtggggacctttcgacctgctgtacggcagcacccagcctctgggcggaagctgcgacaggtgtcctggctggtacatgttccaatttcatagaatcctgcagtacgccagacctagacaggagtctcagcccttcttctggatcttcatggataacctgctgctcacagaggacgaccagatgaccaccgtgcggttcctgcaaacagaggccgtcaccctgcgcgacgtgagatctagagtgctgcagaacgccgtccgggtgtggagcaacatccccggtcttaaaagcaagcacgaggctctgtccccaaaagaggaagagagcctgcagggccacgtgcggaccagatctaagctggccgctcctaaagtggaccccctggtgaagaactgcctgctgcctctgagagagtactttaagtatttcagccagagcagcctgcccctgggaggacctagcagcggcgccccacctccaagcggaggctctccagctggcagccctaccagcacagaggaaggcacaagcgagagcgccacacctgagagcggccctggcacctccaccgagcccagcgagggctctgcccctggcagccccgccggaagccccacctctacagaagaaggcaccagcacagagccttctgaaggctctgcccctggaacatccaccgagcctagcgagaagcggactgccgatggatctgagtttgagagccctaagaaaaaaagaaaggttgggggcgttccagcagctatggcagaaagaccgtttcagtgccgcatttgcatgaacttttctcgctccgctgatcttacacgacatatccgtacgcataccggcgagaaaccctttgcttgtgatatttgtgggcgaaaatttgctcaaagcggtgatttaactaggcatacgaagatacatacccacccgcgggctcccataccaaaacctttccaatgccgcatttgtatgaattttagcagatcagatcatctctcccgacacattaggacgcatactggggagaaaccctttgcctgtgatatttgtggtaggaaatttgcagaccggagcaaccggaagacccacaccaagatccacaccggatctcagaaaccttttcagtgccggatctgcatgaacttcagcaccagcggcagcctgagccgccacatcagaacacacaccggcgagaagccctttgcttgtgatatctgcggaagaaaattcgctcagaacgccaacctgatgaagcacacaaagatccacctgagacagaaggacgccgctagaggctctggcggcgatgccaagagcctgaccgcctggtccaagaggaccgccgacggcagcgagttcgagcccaagaaaaagcggaaggtgtccggctctgaaacccctggcacaagcgagtctgctacacctgagtccagaaccctggtcaccttcaaagacgtgttcgtggacttcaccagagaagaatggaagctgctggataccgctcagcagatcgtgtacagaaacgtgatgctggaaaactacaagaatctggtgtccctgggctaccagctgaccaagcctgacgtgatcctgagactggaaaagggcgaggaacccgctacaaacttcagcctgctgaaacaggccggcgacgtcgaggaaaatcctggccccagcgagctgattaaggaaaacatgcacatgaagctgtatatggaaggcaccgtggacaaccaccatttcaagtgcaccagcgagggcgaaggcaagccctacgagggaacacagaccatgcggatcaaggtggtggaaggcggccctctgcccttcgccttcgacatcctcgccacctctttcctgtacggcagtaagacctttatcaaccacacccagggcatccccgatttcttcaagcagagcttccccgagggatttacctgggagagagtgaccacctacgaggacggcggcgtgctgacagccacccaggacaccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 377 - DNA, 2727 bp, synthetic construct
  misc_feature 1..2727: note = synthetic sequence for use in compositions and/or methods
  source 1..2727: mol_type = other DNA
atggctcggaccaagcagaccgccagaaagagcaccggcggcggagcaagctctggcgccggatcaagttctggcggatctgcagccggcagcggatcatccggtgctagtggctcaagcggatccgccagtagcggcagcggctcaggcggtagcggatcccctgttgagatctacaagaccgtgtccgcctggaagcggcagccaatcagagtgctgagcctgttcggcaatattgacaaggaactgaagtctctgggcttcctggaaagcggcagccacagcgagggcggcacactgaagtacgtggaagatgtgaccaacgtggtgcggagagatgtggaaaagtggggacctttcgacctgctgtacggcagcacccagcctctgggcggaagctgcgacaggtgtcctggctggtacatgttccaatttcatagaatcctgcagtacgccagacctagacaggagtctcagcccttcttctggatcttcatggataacctgctgctcacagaggacgaccagatgaccaccgtgcggttcctgcaaacagaggccgtcaccctgcgcgacgtgagatctagagtgctgcagaacgccgtccgggtgtggagcaacatccccggtcttaaaagcaagcacgaggctctgtccccaaaagaggaagagagcctgcagggccacgtgcggaccagatctaagctggccgctcctaaagtggaccccctggtgaagaactgcctgctgcctctgagagagtactttaagtatttcagccagagcagcctgcccctgggaggacctagcagcggcgccccacctccaagcggaggctctccagctggcagccctaccagcacagaggaaggcacaagcgagagcgccacacctgagagcggccctggcacctccaccgagcccagcgagggctctgcccctggcagccccgccggaagccccacctctacagaagaaggcaccagcacagagccttctgaaggctctgcccctggaacatccaccgagcctagcgagaagcggactgccgatggatctgagtttgagagccctaagaaaaaaagaaaggttgggggcgtgcccgccgccatggccgagagacctttccagtgcagaatctgcatgcgcaacttcagcaccagcggccacctgtctagacacatcagaacccacaccggcgaaaagcctttcgcctgtgatatctgcggcagaaagttcgctcaaagcggccacctgagcagacatacaaagatccacaccggaagccagaaaccatttcagtgtagaatctgcatgagaaacttctccgacagaagccacctgacaagacacattcggacccacacaggcgagaaacctttcgcctgcgacatctgcggccggaaattcgcccagagcagcgatctgcggagacacaccaagatccacacaggatctcagaagccctttcagtgccggatctgcatgcggaatttcagcgaccggagctacagaaacacccacatccggacacataccggcgaaaagccttttgcttgtgacatctgtggcagaaagttcgccagaaggtccgacctgaagcggcacaccaagatccacctgagacagaaggacgccgctagaggctctggcggagatgccaagagcctgaccgcctggtccaagaggaccgccgacggcagcgagttcgagcccaagaaaaagcggaaggtgtccggctctgaaacccctggcacaagcgagtctgctacacctgagtccagaaccctggtcaccttcaaagacgtgttcgtggacttcaccagagaagaatggaagctgctggataccgctcagcagatcgtgtacagaaacgtgatgctggaaaactacaagaatctggtgtccctgggctaccagctgaccaagcctgacgtgatcctgagactggaaaagggcgaggaacccgctacaaacttcagcctgctgaaacaggccggcgacgtcgaggaaaatcctggccccagcgagctgattaaggaaaacatgcacatgaagctgtatatggaaggcaccgtggacaaccaccatttcaagtgcaccagcgagggcgaaggcaagccctacgagggaacacagaccatgcggatcaaggtggtggaaggcggccctctgcccttcgccttcgacatcctcgccacctctttcctgtacggcagtaagacctttatcaaccacacccagggcatccccgatttcttcaagcagagcttccccgagggatttacctgggagagagtgaccacctacgaggacggcggcgtgctgacagccacccaggacaccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 378 - DNA, 2724 bp, synthetic construct
  misc_feature 1..2724: note = synthetic sequence for use in compositions and/or methods
  source 1..2724: mol_type = other DNA
atggctcggaccaagcagaccgccagaaagagcaccggcggcggagcaagctctggcgccggatcaagttctggcggatctgcagccggcagcggatcatccggtgctagtggctcaagcggatccgccagtagcggcagcggctcaggcggtagcggatcccctgttgagatctacaagaccgtgtccgcctggaagcggcagccaatcagagtgctgagcctgttcggcaatattgacaaggaactgaagtctctgggcttcctggaaagcggcagccacagcgagggcggcacactgaagtacgtggaagatgtgaccaacgtggtgcggagagatgtggaaaagtggggacctttcgacctgctgtacggcagcacccagcctctgggcggaagctgcgacaggtgtcctggctggtacatgttccaatttcatagaatcctgcagtacgccagacctagacaggagtctcagcccttcttctggatcttcatggataacctgctgctcacagaggacgaccagatgaccaccgtgcggttcctgcaaacagaggccgtcaccctgcgcgacgtgagatctagagtgctgcagaacgccgtccgggtgtggagcaacatccccggtcttaaaagcaagcacgaggctctgtccccaaaagaggaagagagcctgcagggccacgtgcggaccagatctaagctggccgctcctaaagtggaccccctggtgaagaactgcctgctgcctctgagagagtactttaagtatttcagccagagcagcctgcccctgggaggacctagcagcggcgccccacctccaagcggaggctctccagctggcagccctaccagcacagaggaaggcacaagcgagagcgccacacctgagagcggccctggcacctccaccgagcccagcgagggctctgcccctggcagccccgccggaagccccacctctacagaagaaggcaccagcacagagccttctgaaggctctgcccctggaacatccaccgagcctagcgagaagcggactgccgatggatctgagtttgagagccctaagaaaaaaagaaaggttgggggcgtgcccgccgccatggccgagagacctttccagtgccggatctgcatgcagaacttctccgatagaagcaacctgagccggcacatcagaacacacaccggcgagaagcctttcgcctgcgacatctgtggaaggaagttcgccctgcggcaggacctgaagcggcataccaagatccacacaggctctcagaagccatttcagtgcagaatctgcatgcaaaacttcagcgaccgctccgccctgtctagacacattcggacccacaccggagaaaagccctttgcctgtgatatctgtggcagaaagttcgcccagagcggagatctgaccagacatacaaagatccacacaggcagccagaaacctttccaatgtagaatctgcatgaacttcagcagatctgctaatctcgccagacacatccggacccacaccggcgaaaaaccttttgcctgcgacatctgcggcagaaaattcgctgatagcagcgaccggaaaaagcacacaaagatccacctgagacagaaggacgccgctagaggcagcggcggcgacgcaaagagcctgaccgcctggtccaagaggaccgccgacggcagcgagttcgagcccaagaaaaagcggaaggtgtccggctctgaaacccctggcacaagcgagtctgctacacctgagtccagaaccctggtcaccttcaaagacgtgttcgtggacttcaccagagaagaatggaagctgctggataccgctcagcagatcgtgtacagaaacgtgatgctggaaaactacaagaatctggtgtccctgggctaccagctgaccaagcctgacgtgatcctgagactggaaaagggcgaggaacccgctacaaacttcagcctgctgaaacaggccggcgacgtcgaggaaaatcctggccccagcgagctgattaaggaaaacatgcacatgaagctgtatatggaaggcaccgtggacaaccaccatttcaagtgcaccagcgagggcgaaggcaagccctacgagggaacacagaccatgcggatcaaggtggtggaaggcggccctctgcccttcgccttcgacatcctcgccacctctttcctgtacggcagtaagacctttatcaaccacacccagggcatccccgatttcttcaagcagagcttccccgagggatttacctgggagagagtgaccacctacgaggacggcggcgtgctgacagccacccaggacaccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 379 - DNA, 2730 bp, synthetic construct
  misc_feature 1..2730: note = synthetic sequence for use in compositions and/or methods
  source 1..2730: mol_type = other DNA
atggctcggaccaagcagaccgccagaaagagcaccggcggcggagcaagctctggcgccggatcaagttctggcggatctgcagccggcagcggatcatccggtgctagtggctcaagcggatccgccagtagcggcagcggctcaggcggtagcggatcccctgttgagatctacaagaccgtgtccgcctggaagcggcagccaatcagagtgctgagcctgttcggcaatattgacaaggaactgaagtctctgggcttcctggaaagcggcagccacagcgagggcggcacactgaagtacgtggaagatgtgaccaacgtggtgcggagagatgtggaaaagtggggacctttcgacctgctgtacggcagcacccagcctctgggcggaagctgcgacaggtgtcctggctggtacatgttccaatttcatagaatcctgcagtacgccagacctagacaggagtctcagcccttcttctggatcttcatggataacctgctgctcacagaggacgaccagatgaccaccgtgcggttcctgcaaacagaggccgtcaccctgcgcgacgtgagatctagagtgctgcagaacgccgtccgggtgtggagcaacatccccggtcttaaaagcaagcacgaggctctgtccccaaaagaggaagagagcctgcagggccacgtgcggaccagatctaagctggccgctcctaaagtggaccccctggtgaagaactgcctgctgcctctgagagagtactttaagtatttcagccagagcagcctgcccctgggaggacctagcagcggcgccccacctccaagcggaggctctccagctggcagccctaccagcacagaggaaggcacaagcgagagcgccacacctgagagcggccctggcacctccaccgagcccagcgagggctctgcccctggcagccccgccggaagccccacctctacagaagaaggcaccagcacagagccttctgaaggctctgcccctggaacatccaccgagcctagcgagaagcggactgccgatggatctgagtttgagagccctaagaaaaaaagaaaggttgggggtgttcccgcagctatggcagaaagaccctttcagtgcaggatttgtatgaacttttctcaatctgggcatttggcccgccatatacgcacacatactggggaaaagcccttcgcttgtgatatttgtggacggaagtttgcacaacttacgcatctcaattcccatactaagattcatacgcacccccgcgcaccaattccgaaaccattccaatgtcgtatatgtatgaacttttcacgctcagataatttggctaggcatattagaacgcataccggtgagaaaccgtttgcgtgcgatatttgcggccgaaaatttgctatgcgtcatcatttggacgatcatactaaaattcatactgggagccaaaagcccttccaatgtcgcatatgtatgaatttcagcctgcggcatcacctgaccagacacatcagaacacatacaggcgaaaagccattcgcctgcgacatctgtggcagaaagttcgcagatagatcctaccgcaacacccacaccaagatccacctgagacagaaggacgctgccaggggcagcggaggagatgccaagagcctgaccgcctggtccaagaggaccgccgacggcagcgagttcgagcccaagaaaaagcggaaggtgtccggctctgaaacccctggcacaagcgagtctgctacacctgagtccagaaccctggtcaccttcaaagacgtgttcgtggacttcaccagagaagaatggaagctgctggataccgctcagcagatcgtgtacagaaacgtgatgctggaaaactacaagaatctggtgtccctgggctaccagctgaccaagcctgacgtgatcctgagactggaaaagggcgaggaacccgctacaaacttcagcctgctgaaacaggccggcgacgtcgaggaaaatcctggccccagcgagctgattaaggaaaacatgcacatgaagctgtatatggaaggcaccgtggacaaccaccatttcaagtgcaccagcgagggcgaaggcaagccctacgagggaacacagaccatgcggatcaaggtggtggaaggcggccctctgcccttcgccttcgacatcctcgccacctctttcctgtacggcagtaagacctttatcaaccacacccagggcatccccgatttcttcaagcagagcttccccgagggatttacctgggagagagtgaccacctacgaggacggcggcgtgctgacagccacccaggacaccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 380 - DNA, 2739 bp, synthetic construct
  misc_feature 1..2739: note = synthetic sequence for use in compositions and/or methods
  source 1..2739: mol_type = other DNA
atggctcggaccaagcagaccgccagaaagagcaccggcggcggagcaagctctggcgccggatcaagttctggcggatctgcagccggcagcggatcatccggtgctagtggctcaagcggatccgccagtagcggcagcggctcaggcggtagcggatcccctgttgagatctacaagaccgtgtccgcctggaagcggcagccaatcagagtgctgagcctgttcggcaatattgacaaggaactgaagtctctgggcttcctggaaagcggcagccacagcgagggcggcacactgaagtacgtggaagatgtgaccaacgtggtgcggagagatgtggaaaagtggggacctttcgacctgctgtacggcagcacccagcctctgggcggaagctgcgacaggtgtcctggctggtacatgttccaatttcatagaatcctgcagtacgccagacctagacaggagtctcagcccttcttctggatcttcatggataacctgctgctcacagaggacgaccagatgaccaccgtgcggttcctgcaaacagaggccgtcaccctgcgcgacgtgagatctagagtgctgcagaacgccgtccgggtgtggagcaacatccccggtcttaaaagcaagcacgaggctctgtccccaaaagaggaagagagcctgcagggccacgtgcggaccagatctaagctggccgctcctaaagtggaccccctggtgaagaactgcctgctgcctctgagagagtactttaagtatttcagccagagcagcctgcccctgggaggacctagcagcggcgccccacctccaagcggaggctctccagctggcagccctaccagcacagaggaaggcacaagcgagagcgccacacctgagagcggccctggcacctccaccgagcccagcgagggctctgcccctggcagccccgccggaagccccacctctacagaagaaggcaccagcacagagccttctgaaggctctgcccctggaacatccaccgagcctagcgagaagcggactgccgatggatctgagtttgagagccctaagaaaaaaagaaaggttgggggagttcccgcagcaatggcagaaaggcctttccaatgtcgcatttgtatgcgaaattttagccggagcgatgatttgacccgccatatacgaactcatactggagagaaaccttttgcatgcgacatctgcgggcggaaatttgctcaatcatcagatcttcgacgtcataccaaaattcatacaggcagtcaaaagccttttcaatgtaggatttgtatgcgcaactttagtgaccgcagtcatttaacacgccacattcgcactcacaccggcgagaagccatttgcatgtgacatttgtgggcgtaaatttgccaggttggattggcttccaatgcatactaaaatacatactcatccacgagctccgataccaaaaccatttcagtgccgaatttgtatgcgcaattttagcaccagcggcaacctgaccagacacatcagaacccacaccggagagaaaccttttgcctgtgacatctgcggccggaagtttgccgacctgacaacactgagaaagcacaccaagatccacctcagacagaaagacgccgccagaggcagcggcggcgatgccaagagcctgaccgcctggtccaagaggaccgccgacggcagcgagttcgagcccaagaaaaagcggaaggtgtccggctctgaaacccctggcacaagcgagtctgctacacctgagtccagaaccctggtcaccttcaaagacgtgttcgtggacttcaccagagaagaatggaagctgctggataccgctcagcagatcgtgtacagaaacgtgatgctggaaaactacaagaatctggtgtccctgggctaccagctgaccaagcctgacgtgatcctgagactggaaaagggcgaggaacccgctacaaacttcagcctgctgaaacaggccggcgacgtcgaggaaaatcctggccccagcgagctgattaaggaaaacatgcacatgaagctgtatatggaaggcaccgtggacaaccaccatttcaagtgcaccagcgagggcgaaggcaagccctacgagggaacacagaccatgcggatcaaggtggtggaaggcggccctctgcccttcgccttcgacatcctcgccacctctttcctgtacggcagtaagacctttatcaaccacacccagggcatccccgatttcttcaagcagagcttccccgagggatttacctgggagagagtgaccacctacgaggacggcggcgtgctgacagccacccaggacaccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 381 - DNA, 2739 bp, synthetic construct
  misc_feature 1..2739: note = synthetic sequence for use in compositions and/or methods
  source 1..2739: mol_type = other DNA
atggctcggaccaagcagaccgccagaaagagcaccggcggcggagcaagctctggcgccggatcaagttctggcggatctgcagccggcagcggatcatccggtgctagtggctcaagcggatccgccagtagcggcagcggctcaggcggtagcggatcccctgttgagatctacaagaccgtgtccgcctggaagcggcagccaatcagagtgctgagcctgttcggcaatattgacaaggaactgaagtctctgggcttcctggaaagcggcagccacagcgagggcggcacactgaagtacgtggaagatgtgaccaacgtggtgcggagagatgtggaaaagtggggacctttcgacctgctgtacggcagcacccagcctctgggcggaagctgcgacaggtgtcctggctggtacatgttccaatttcatagaatcctgcagtacgccagacctagacaggagtctcagcccttcttctggatcttcatggataacctgctgctcacagaggacgaccagatgaccaccgtgcggttcctgcaaacagaggccgtcaccctgcgcgacgtgagatctagagtgctgcagaacgccgtccgggtgtggagcaacatccccggtcttaaaagcaagcacgaggctctgtccccaaaagaggaagagagcctgcagggccacgtgcggaccagatctaagctggccgctcctaaagtggaccccctggtgaagaactgcctgctgcctctgagagagtactttaagtatttcagccagagcagcctgcccctgggaggacctagcagcggcgccccacctccaagcggaggctctccagctggcagccctaccagcacagaggaaggcacaagcgagagcgccacacctgagagcggccctggcacctccaccgagcccagcgagggctctgcccctggcagccccgccggaagccccacctctacagaagaaggcaccagcacagagccttctgaaggctctgcccctggaacatccaccgagcctagcgagaagcggactgccgatggatctgagtttgagagccctaagaaaaaaagaaaggttgggggagtgcctgctgctatggccgagagaccatttcagtgcagaatctgcatgcgcaatttcagcaccagcggaaatctcacaagacacatccggacccataccggcgagaagccctttgcctgcgatatctgcggcagaaagttcgctctgtctcaggacctgaaccggcacaccaagatccacacacaccccagagcccctatccccaagcctttccagtgccggatttgcatgcggaacttcagcgacaggtccgccctgagcagacatatcagaacacacaccggcgaaaagccttttgcttgtgatatctgtggcagaaagttcgcccggaacgacgacagaaaaaagcacacaaagatccacaccggatctcagaaacctttccaatgtagaatctgcatgagaaacttcagccagagcggcaacctggccagacacatccggacccacacaggcgaaaagcctttcgcctgtgatatctgcggccggaaattcgcccagagaatcgacctgacccggcacaccaagatccacctgagacagaaggacgccgccagaggcagcggcggcgacgccaagagcctgaccgcctggtccaagaggaccgccgacggcagcgagttcgagcccaagaaaaagcggaaggtgtccggctctgaaacccctggcacaagcgagtctgctacacctgagtccagaaccctggtcaccttcaaagacgtgttcgtggacttcaccagagaagaatggaagctgctggataccgctcagcagatcgtgtacagaaacgtgatgctggaaaactacaagaatctggtgtccctgggctaccagctgaccaagcctgacgtgatcctgagactggaaaagggcgaggaacccgctacaaacttcagcctgctgaaacaggccggcgacgtcgaggaaaatcctggccccagcgagctgattaaggaaaacatgcacatgaagctgtatatggaaggcaccgtggacaaccaccatttcaagtgcaccagcgagggcgaaggcaagccctacgagggaacacagaccatgcggatcaaggtggtggaaggcggccctctgcccttcgccttcgacatcctcgccacctctttcctgtacggcagtaagacctttatcaaccacacccagggcatccccgatttcttcaagcagagcttccccgagggatttacctgggagagagtgaccacctacgaggacggcggcgtgctgacagccacccaggacaccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 382 - DNA, 2727 bp, synthetic construct
  misc_feature 1..2727: note = synthetic sequence for use in compositions and/or methods
  source 1..2727: mol_type = other DNA
atggctcggaccaagcagaccgccagaaagagcaccggcggcggagcaagctctggcgccggatcaagttctggcggatctgcagccggcagcggatcatccggtgctagtggctcaagcggatccgccagtagcggcagcggctcaggcggtagcggatcccctgttgagatctacaagaccgtgtccgcctggaagcggcagccaatcagagtgctgagcctgttcggcaatattgacaaggaactgaagtctctgggcttcctggaaagcggcagccacagcgagggcggcacactgaagtacgtggaagatgtgaccaacgtggtgcggagagatgtggaaaagtggggacctttcgacctgctgtacggcagcacccagcctctgggcggaagctgcgacaggtgtcctggctggtacatgttccaatttcatagaatcctgcagtacgccagacctagacaggagtctcagcccttcttctggatcttcatggataacctgctgctcacagaggacgaccagatgaccaccgtgcggttcctgcaaacagaggccgtcaccctgcgcgacgtgagatctagagtgctgcagaacgccgtccgggtgtggagcaacatccccggtcttaaaagcaagcacgaggctctgtccccaaaagaggaagagagcctgcagggccacgtgcggaccagatctaagctggccgctcctaaagtggaccccctggtgaagaactgcctgctgcctctgagagagtactttaagtatttcagccagagcagcctgcccctgggaggacctagcagcggcgccccacctccaagcggaggctctccagctggcagccctaccagcacagaggaaggcacaagcgagagcgccacacctgagagcggccctggcacctccaccgagcccagcgagggctctgcccctggcagccccgccggaagccccacctctacagaagaaggcaccagcacagagccttctgaaggctctgcccctggaacatccaccgagcctagcgagaagcggactgccgatggatctgagtttgagagccctaagaaaaaaagaaaggttgggggcgtgcccgctgctatggccgagcggcctttccagtgtagaatctgcatgcgcaatttcagcagatctgaccacctgagcgagcacattcggacacacaccggagagaagccttttgcctgcgatatctgtggaagaaagttcgcctacagctggcggctgtcccagcacaccaagatccacaccggctctcaaaaaccctttcagtgcaggatctgtatgcggaacttcagcctgcggcaccacctgaccagacacatccggacccacactggggagaaaccctttgcttgcgacatttgtggacgtaaatttgcccaaagtgggacccgcaaaacgcataccaagattcatacaggaagccaaaagccattccaatgtcggatatgtatgaggaattttagcagatcagacgtcttgtccaaacatattcgcactcacaccggggagaaaccttttgcgtgtgatatttgtggtaggaaatttgcgagaagcgacgacagaatcaagcacaccaagatccatctgagacagaaagacgccgccagaggcagcggcggcgacgccaagagcctgacagcctggtccaagaggaccgccgacggcagcgagttcgagcccaagaaaaagcggaaggtgtccggctctgaaacccctggcacaagcgagtctgctacacctgagtccagaaccctggtcaccttcaaagacgtgttcgtggacttcaccagagaagaatggaagctgctggataccgctcagcagatcgtgtacagaaacgtgatgctggaaaactacaagaatctggtgtccctgggctaccagctgaccaagcctgacgtgatcctgagactggaaaagggcgaggaacccgctacaaacttcagcctgctgaaacaggccggcgacgtcgaggaaaatcctggccccagcgagctgattaaggaaaacatgcacatgaagctgtatatggaaggcaccgtggacaaccaccatttcaagtgcaccagcgagggcgaaggcaagccctacgagggaacacagaccatgcggatcaaggtggtggaaggcggccctctgcccttcgccttcgacatcctcgccacctctttcctgtacggcagtaagacctttatcaaccacacccagggcatccccgatttcttcaagcagagcttccccgagggatttacctgggagagagtgaccacctacgaggacggcggcgtgctgacagccacccaggacaccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 383 - DNA, 5949 bp, synthetic construct
  misc_feature 1..5949: note = synthetic sequence for use in compositions and/or methods
  source 1..5949: mol_type = other DNA
atggctcggaccaagcagaccgccagaaagagcaccggcggcggagcaagctctggcgccggatcaagttctggcggatctgcagccggcagcggatcatccggtgctagtggctcaagcggatccgccagtagcggcagcggctcaggcggtagcggaggctcatcccctgttgagatctacaagaccgtgtccgcctggaagcggcagccaatcagagtgctgagcctgttcggcaatattgacaaggaactgaagtctctgggcttcctggaaagcggcagccacagcgagggcggcacactgaagtacgtggaagatgtgaccaacgtggtgcggagagatgtggaaaagtggggacctttcgacctgctgtacggcagcacccagcctctgggcggaagctgcgacaggtgtcctggctggtacatgttccaatttcatagaatcctgcagtacgccagacctagacaggagtctcagcccttcttctggatcttcatggataacctgctgctcacagaggacgaccagatgaccaccgtgcggttcctgcaaacagaggccgtcaccctgcgcgacgtgagatctagagtgctgcagaacgccgtccgggtgtggagcaacatccccggtcttaaaagcaagcacgaggctctgtccccaaaagaggaagagagcctgcagggccacgtgcggaccagatctaagctggccgctcctaaagtggaccccctggtgaagaactgcctgctgcctctgagagagtactttaagtatttcagccagagcagcctgcccctgggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtggccacaaatttcagcctgctgaagcaggccggcgacgtggaagagaatcctggccccagcgagctgatcaaagagaacatgcacatgaagctgtacatggaaggcaccgtggacaaccatcacttcaagtgcaccagcgagggcgagggcaagccctacgagggcacacagaccatgagaatcaaggtggtggaaggaggcccactgcccttcgccttcgacatcctggccaccagctttctgtacggctcaaagaccttcatcaaccacacccagggcatccctgatttcttcaagcagagcttccctgagggatttacctgggagagagtgacaacttatgaagatggcggagtgctgaccgccacacaagataccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 384 - DNA, 5955 bp, synthetic construct
  misc_feature 1..5955: note = synthetic sequence for use in compositions and/or methods
  source 1..5955: mol_type = other DNA
atggctcggaccaagcagaccgccagaaagagcaccggcggcggagcaagctctggcgccggatcaagttctggcggatctgcagccggcagcggatcatccggtgctagtggctcaagcggatccgccagtagcggcagcggctcaggcggtagcggaggctcaagcggctcccctgttgagatctacaagaccgtgtccgcctggaagcggcagccaatcagagtgctgagcctgttcggcaatattgacaaggaactgaagtctctgggcttcctggaaagcggcagccacagcgagggcggcacactgaagtacgtggaagatgtgaccaacgtggtgcggagagatgtggaaaagtggggacctttcgacctgctgtacggcagcacccagcctctgggcggaagctgcgacaggtgtcctggctggtacatgttccaatttcatagaatcctgcagtacgccagacctagacaggagtctcagcccttcttctggatcttcatggataacctgctgctcacagaggacgaccagatgaccaccgtgcggttcctgcaaacagaggccgtcaccctgcgcgacgtgagatctagagtgctgcagaacgccgtccgggtgtggagcaacatccccggtcttaaaagcaagcacgaggctctgtccccaaaagaggaagagagcctgcagggccacgtgcggaccagatctaagctggccgctcctaaagtggaccccctggtgaagaactgcctgctgcctctgagagagtactttaagtatttcagccagagcagcctgcccctgggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtggccacaaatttcagcctgctgaagcaggccggcgacgtggaagagaatcctggccccagcgagctgatcaaagagaacatgcacatgaagctgtacatggaaggcaccgtggacaaccatcacttcaagtgcaccagcgagggcgagggcaagccctacgagggcacacagaccatgagaatcaaggtggtggaaggaggcccactgcccttcgccttcgacatcctggccaccagctttctgtacggctcaaagaccttcatcaaccacacccagggcatccctgatttcttcaagcagagcttccctgagggatttacctgggagagagtgacaacttatgaagatggcggagtgctgaccgccacacaagataccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 385 - DNA, 5961 bp, synthetic construct
  misc_feature 1..5961: note = synthetic sequence for use in compositions and/or methods
  source 1..5961: mol_type = other DNA
atggctcggaccaagcagaccgccagaaagagcaccggcggcggagcaagctctggcgccggatcaagttctggcggatctgcagccggcagcggatcatccggtgctagtggctcaagcggatccgccagtagcggcagcggctcaggcggtagcggaggctcaagcggcggatcctcccctgttgagatctacaagaccgtgtccgcctggaagcggcagccaatcagagtgctgagcctgttcggcaatattgacaaggaactgaagtctctgggcttcctggaaagcggcagccacagcgagggcggcacactgaagtacgtggaagatgtgaccaacgtggtgcggagagatgtggaaaagtggggacctttcgacctgctgtacggcagcacccagcctctgggcggaagctgcgacaggtgtcctggctggtacatgttccaatttcatagaatcctgcagtacgccagacctagacaggagtctcagcccttcttctggatcttcatggataacctgctgctcacagaggacgaccagatgaccaccgtgcggttcctgcaaacagaggccgtcaccctgcgcgacgtgagatctagagtgctgcagaacgccgtccgggtgtggagcaacatccccggtcttaaaagcaagcacgaggctctgtccccaaaagaggaagagagcctgcagggccacgtgcggaccagatctaagctggccgctcctaaagtggaccccctggtgaagaactgcctgctgcctctgagagagtactttaagtatttcagccagagcagcctgcccctgggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtggccacaaatttcagcctgctgaagcaggccggcgacgtggaagagaatcctggccccagcgagctgatcaaagagaacatgcacatgaagctgtacatggaaggcaccgtggacaaccatcacttcaagtgcaccagcgagggcgagggcaagccctacgagggcacacagaccatgagaatcaaggtggtggaaggaggcccactgcccttcgccttcgacatcctggccaccagctttctgtacggctcaaagaccttcatcaaccacacccagggcatccctgatttcttcaagcagagcttccctgagggatttacctgggagagagtgacaacttatgaagatggcggagtgctgaccgccacacaagataccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 386 - DNA, 5937 bp, synthetic construct
  misc_feature 1..5937: note = synthetic sequence for use in compositions and/or methods
  source 1..5937: mol_type = other DNA
atggctcggaccaagcagaccgccagaaagagcaccggcggcggagcaagctctggcgccggatcaagttctggcggatctgcagccggcagcggatcatccggtgctagtggctcaagcggatccgccagtagcggcagcggctcaggcggttcccctgttgagatctacaagaccgtgtccgcctggaagcggcagccaatcagagtgctgagcctgttcggcaatattgacaaggaactgaagtctctgggcttcctggaaagcggcagccacagcgagggcggcacactgaagtacgtggaagatgtgaccaacgtggtgcggagagatgtggaaaagtggggacctttcgacctgctgtacggcagcacccagcctctgggcggaagctgcgacaggtgtcctggctggtacatgttccaatttcatagaatcctgcagtacgccagacctagacaggagtctcagcccttcttctggatcttcatggataacctgctgctcacagaggacgaccagatgaccaccgtgcggttcctgcaaacagaggccgtcaccctgcgcgacgtgagatctagagtgctgcagaacgccgtccgggtgtggagcaacatccccggtcttaaaagcaagcacgaggctctgtccccaaaagaggaagagagcctgcagggccacgtgcggaccagatctaagctggccgctcctaaagtggaccccctggtgaagaactgcctgctgcctctgagagagtactttaagtatttcagccagagcagcctgcccctgggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtggccacaaatttcagcctgctgaagcaggccggcgacgtggaagagaatcctggccccagcgagctgatcaaagagaacatgcacatgaagctgtacatggaaggcaccgtggacaaccatcacttcaagtgcaccagcgagggcgagggcaagccctacgagggcacacagaccatgagaatcaaggtggtggaaggaggcccactgcccttcgccttcgacatcctggccaccagctttctgtacggctcaaagaccttcatcaaccacacccagggcatccctgatttcttcaagcagagcttccctgagggatttacctgggagagagtgacaacttatgaagatggcggagtgctgaccgccacacaagataccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 387 - DNA, 5931 bp, synthetic construct
  misc_feature 1..5931: note = synthetic sequence for use in compositions and/or methods
  source 1..5931: mol_type = other DNA
atggctcggaccaagcagaccgccagaaagagcaccggcggcggagcaagctctggcgccggatcaagttctggcggatctgcagccggcagcggatcatccggtgctagtggctcaagcggatccgccagtagcggcagcggctcatcccctgttgagatctacaagaccgtgtccgcctggaagcggcagccaatcagagtgctgagcctgttcggcaatattgacaaggaactgaagtctctgggcttcctggaaagcggcagccacagcgagggcggcacactgaagtacgtggaagatgtgaccaacgtggtgcggagagatgtggaaaagtggggacctttcgacctgctgtacggcagcacccagcctctgggcggaagctgcgacaggtgtcctggctggtacatgttccaatttcatagaatcctgcagtacgccagacctagacaggagtctcagcccttcttctggatcttcatggataacctgctgctcacagaggacgaccagatgaccaccgtgcggttcctgcaaacagaggccgtcaccctgcgcgacgtgagatctagagtgctgcagaacgccgtccgggtgtggagcaacatccccggtcttaaaagcaagcacgaggctctgtccccaaaagaggaagagagcctgcagggccacgtgcggaccagatctaagctggccgctcctaaagtggaccccctggtgaagaactgcctgctgcctctgagagagtactttaagtatttcagccagagcagcctgcccctgggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtggccacaaatttcagcctgctgaagcaggccggcgacgtggaagagaatcctggccccagcgagctgatcaaagagaacatgcacatgaagctgtacatggaaggcaccgtggacaaccatcacttcaagtgcaccagcgagggcgagggcaagccctacgagggcacacagaccatgagaatcaaggtggtggaaggaggcccactgcccttcgccttcgacatcctggccaccagctttctgtacggctcaaagaccttcatcaaccacacccagggcatccctgatttcttcaagcagagcttccctgagggatttacctgggagagagtgacaacttatgaagatggcggagtgctgaccgccacacaagataccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 388 - DNA, 5997 bp, synthetic construct
  misc_feature 1..5997: note = synthetic sequence for use in compositions and/or methods
  source 1..5997: mol_type = other DNA
atggccaggaccaaacaaactgccagaaagagcaccggggggaaagcgccccgaaaacagctggcgaccaaagcagcccgcaaaagcgcaccgggaggtgcaagcagtggggcaggaagttcctcaggaggaagtgcggcgggatccggaagcggtggcgcatcaagtggcgccgcaagtagcagtgccgggtccgcagctggctccgggtcctcccctgttgagatctacaagaccgtgtccgcctggaagcggcagccaatcagagtgctgagcctgttcggcaatattgacaaggaactgaagtctctgggcttcctggaaagcggcagccacagcgagggcggcacactgaagtacgtggaagatgtgaccaacgtggtgcggagagatgtggaaaagtggggacctttcgacctgctgtacggcagcacccagcctctgggcggaagctgcgacaggtgtcctggctggtacatgttccaatttcatagaatcctgcagtacgccagacctagacaggagtctcagcccttcttctggatcttcatggataacctgctgctcacagaggacgaccagatgaccaccgtgcggttcctgcaaacagaggccgtcaccctgcgcgacgtgagatctagagtgctgcagaacgccgtccgggtgtggagcaacatccccggtcttaaaagcaagcacgaggctctgtccccaaaagaggaagagagcctgcagggccacgtgcggaccagatctaagctggccgctcctaaagtggaccccctggtgaagaactgcctgctgcctctgagagagtactttaagtatttcagccagagcagcctgcccctgggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtggccacaaatttcagcctgctgaagcaggccggcgacgtggaagagaatcctggccccagcgagctgatcaaagagaacatgcacatgaagctgtacatggaaggcaccgtggacaaccatcacttcaagtgcaccagcgagggcgagggcaagccctacgagggcacacagaccatgagaatcaaggtggtggaaggaggcccactgcccttcgccttcgacatcctggccaccagctttctgtacggctcaaagaccttcatcaaccacacccagggcatccctgatttcttcaagcagagcttccctgagggatttacctgggagagagtgacaacttatgaagatggcggagtgctgaccgccacacaagataccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 389 - DNA, 5973 bp, synthetic construct
  misc_feature 1..5973: note = synthetic sequence for use in compositions and/or methods
  source 1..5973: mol_type = other DNA
atggccaggaccaaacaaactgccagaaagagcaccggggggaaagcgccccgaaaacagctggcgaccaaagcagcccgcaaaagcgcaccgggaggtgcaagcagtggggcaggaagttcctcaggaggaagtgcggcgggatccggaagcggtggcgcatcaagtggcgccgcaagtagcagtgcctcccctgttgagatctacaagaccgtgtccgcctggaagcggcagccaatcagagtgctgagcctgttcggcaatattgacaaggaactgaagtctctgggcttcctggaaagcggcagccacagcgagggcggcacactgaagtacgtggaagatgtgaccaacgtggtgcggagagatgtggaaaagtggggacctttcgacctgctgtacggcagcacccagcctctgggcggaagctgcgacaggtgtcctggctggtacatgttccaatttcatagaatcctgcagtacgccagacctagacaggagtctcagcccttcttctggatcttcatggataacctgctgctcacagaggacgaccagatgaccaccgtgcggttcctgcaaacagaggccgtcaccctgcgcgacgtgagatctagagtgctgcagaacgccgtccgggtgtggagcaacatccccggtcttaaaagcaagcacgaggctctgtccccaaaagaggaagagagcctgcagggccacgtgcggaccagatctaagctggccgctcctaaagtggaccccctggtgaagaactgcctgctgcctctgagagagtactttaagtatttcagccagagcagcctgcccctgggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtggccacaaatttcagcctgctgaagcaggccggcgacgtggaagagaatcctggccccagcgagctgatcaaagagaacatgcacatgaagctgtacatggaaggcaccgtggacaaccatcacttcaagtgcaccagcgagggcgagggcaagccctacgagggcacacagaccatgagaatcaaggtggtggaaggaggcccactgcccttcgccttcgacatcctggccaccagctttctgtacggctcaaagaccttcatcaaccacacccagggcatccctgatttcttcaagcagagcttccctgagggatttacctgggagagagtgacaacttatgaagatggcggagtgctgaccgccacacaagataccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 390 - DNA, 5955 bp, synthetic construct
  misc_feature 1..5955: note = synthetic sequence for use in compositions and/or methods
  source 1..5955: mol_type = other DNA
atggccaggaccaaacaaactgccagaaagagcaccggggggaaagcgccccgaaaacagctggcgaccaaagcagcccgcaaaagcgcaccgggaggtgcaagcagtggggcaggaagttcctcaggaggaagtgcggcgggatccggaagcggtggcgcatcaagtggctcccctgttgagatctacaagaccgtgtccgcctggaagcggcagccaatcagagtgctgagcctgttcggcaatattgacaaggaactgaagtctctgggcttcctggaaagcggcagccacagcgagggcggcacactgaagtacgtggaagatgtgaccaacgtggtgcggagagatgtggaaaagtggggacctttcgacctgctgtacggcagcacccagcctctgggcggaagctgcgacaggtgtcctggctggtacatgttccaatttcatagaatcctgcagtacgccagacctagacaggagtctcagcccttcttctggatcttcatggataacctgctgctcacagaggacgaccagatgaccaccgtgcggttcctgcaaacagaggccgtcaccctgcgcgacgtgagatctagagtgctgcagaacgccgtccgggtgtggagcaacatccccggtcttaaaagcaagcacgaggctctgtccccaaaagaggaagagagcctgcagggccacgtgcggaccagatctaagctggccgctcctaaagtggaccccctggtgaagaactgcctgctgcctctgagagagtactttaagtatttcagccagagcagcctgcccctgggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtggccacaaatttcagcctgctgaagcaggccggcgacgtggaagagaatcctggccccagcgagctgatcaaagagaacatgcacatgaagctgtacatggaaggcaccgtggacaaccatcacttcaagtgcaccagcgagggcgagggcaagccctacgagggcacacagaccatgagaatcaaggtggtggaaggaggcccactgcccttcgccttcgacatcctggccaccagctttctgtacggctcaaagaccttcatcaaccacacccagggcatccctgatttcttcaagcagagcttccctgagggatttacctgggagagagtgacaacttatgaagatggcggagtgctgaccgccacacaagataccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 391 - DNA, 5937 bp, synthetic construct
  misc_feature 1..5937: note = synthetic sequence for use in compositions and/or methods
  source 1..5937: mol_type = other DNA
atggccaggaccaaacaaactgccagaaagagcaccggggggaaagcgccccgaaaacagctggcgaccaaagcagcccgcaaaagcgcaccgggaggtgcaagcagtggggcaggaagttcctcaggaggaagtgcggcgggatccggaagctcccctgttgagatctacaagaccgtgtccgcctggaagcggcagccaatcagagtgctgagcctgttcggcaatattgacaaggaactgaagtctctgggcttcctggaaagcggcagccacagcgagggcggcacactgaagtacgtggaagatgtgaccaacgtggtgcggagagatgtggaaaagtggggacctttcgacctgctgtacggcagcacccagcctctgggcggaagctgcgacaggtgtcctggctggtacatgttccaatttcatagaatcctgcagtacgccagacctagacaggagtctcagcccttcttctggatcttcatggataacctgctgctcacagaggacgaccagatgaccaccgtgcggttcctgcaaacagaggccgtcaccctgcgcgacgtgagatctagagtgctgcagaacgccgtccgggtgtggagcaacatccccggtcttaaaagcaagcacgaggctctgtccccaaaagaggaagagagcctgcagggccacgtgcggaccagatctaagctggccgctcctaaagtggaccccctggtgaagaactgcctgctgcctctgagagagtactttaagtatttcagccagagcagcctgcccctgggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtggccacaaatttcagcctgctgaagcaggccggcgacgtggaagagaatcctggccccagcgagctgatcaaagagaacatgcacatgaagctgtacatggaaggcaccgtggacaaccatcacttcaagtgcaccagcgagggcgagggcaagccctacgagggcacacagaccatgagaatcaaggtggtggaaggaggcccactgcccttcgccttcgacatcctggccaccagctttctgtacggctcaaagaccttcatcaaccacacccagggcatccctgatttcttcaagcagagcttccctgagggatttacctgggagagagtgacaacttatgaagatggcggagtgctgaccgccacacaagataccagcctgcaggacggctgtctgatctacaacgtgaagatcagaggcgtgaacttcaccagcaacggccctgtgatgcagaaaaaaaccctgggctgggaggcctttacagagacactgtaccccgctgatggaggcctggaaggtagaaacgacatggccctgaaactggtcggcggcagccacctgattgccaatatcaagaccacataccggagcaagaaaccagctaaaaacctgaagatgcctggcgtttactacgtggattacagactggagcggatcaaggaagccaacaacgagacatatgtggaacagcacgaggtggccgtagctagatactgcgacctgccttctaagcttggccacaagctgaactgataa

SEQ ID NO: 392 - DNA, 49 bp, synthetic construct
  misc_feature 1..49: note = synthetic sequence for use in compositions and/or methods
  source 1..49: mol_type = other DNA
aataaaatatctttattttcattacatctgtgtgttggttttttgtgtg

SEQ ID NO: 393 - protein, 136 aa, Homo sapiens
MARTKQTARKSTGGKAPRKQLATKAARKSAPATGGVKKPHRYRPGTVALREIRRYQKSTELLIRKLPFQRLVREIAQDFKTDLRFQSSAVMALQEACEAYLVGLFEDTNLCAIHAKRVTIMPKDIQLARRIRGERA

SEQ ID NO: 394 - protein, 136 aa, Homo sapiens [sequence omitted]

SEQ ID NO: 395 - protein, 136 aa, synthetic construct
  REGION 1..136: note = synthetic construct
MARTKQTARKSTGGKAPRKQLATKAARKSAPSTGGVKKPHRYRPGTVALREIRRYQKSTELLIRKLPFQRLVREIAQDFKTDLRFQSAAIGALQEASEAYLVGLFEDTNLCAIHAKRVTIMPKDIQLARRIRGERA

SEQ ID NO: 396 - protein, 136 aa, Homo sapiens
MARTKQTARKSTGGKAPRKQLATKVARKSAPATGGVKKPHRYRPGTVALREIRRYQKSTELLIRKLPFQRLMREIAQDFKTDLRFQSSAVMALQEACESYLVGLFEDTNLCVIHAKRVTIMPKDIQLARRIRGERA

SEQ ID NO: 397 - protein, 1824 aa, synthetic construct
  REGION 1..1824: note = synthetic construct
MARTKQTARKSTGGKAPRKQLATKAARKSAPGGASSGAGSSSGGSAAGSGSGGASSGAASSSAGSAAGSGSSPVEIYKTVSAWKRQPIRVLSLFGNIDKELKSLGFLESGSHSEGGTLKYVEDVTNVVRRDVEKWGPFDLLYGSTQPLGGSCDRCPGWYMFQFHRILQYARPRQESQPFFWIFMDNLLLTEDDQMTTVRFLQTEAVTLRDVRSRVLQNAVRVWSNIPGLKSKHEALSPKEEESLQGHVRTRSKLAAPKVDPLVKNCLLPLREYFKYFSQSSLPLGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKVSGSETPGTSESATPESRTLVTFKDVFVDFTREEWKLLDTAQQIVYRNVMLENYKNLVSLGYQLTKPDVILRLEKGEEP

SEQ ID NO: 398 - protein, 1816 aa, synthetic construct
  REGION 1..1816: note = synthetic construct
MARTKQTARKSTGGKAPRKQLATKAARKSAPGGASSGAGSSSGGSAAGSGSGGASSGAASSSARTLVTFKDVFVDFTREEWKLLDTAQQIVYRNVMLENYKNLVSLGYQLTKPDVILRLEKGEEPSGSETPGTSESATPESSPVEIYKTVSAWKRQPIRVLSLFGNIDKELKSLGFLESGSHSEGGTLKYVEDVTNVVRRDVEKWGPFDLLYGSTQPLGGSCDRCPGWYMFQFHRILQYARPRQESQPFFWIFMDNLLLTEDDQMTTVRFLQTEAVTLRDVRSRVLQNAVRVWSNIPGLKSKHEALSPKEEESLQGHVRTRSKLAAPKVDPLVKNCLLPLREYFKYFSQSSLPLGGPSSGAPPPSGGSPAGSPTSTEEGTSESATPESGPGTSTEPSEGSAPGSPAGSPTSTEEGTSTEPSEGSAPGTSTEPSEPKKKRKVMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDPKKKRKV

SEQ ID NO: 399 - DNA, 5475 bp, synthetic construct
  misc_feature 1..5475: note = synthetic construct
  source 1..5475: mol_type = other DNA
atggccaggaccaaacaaactgccagaaagagcaccggggggaaagcgccccgaaaacagctggcgaccaaagcagcccgcaaaagcgcaccgggaggtgcaagcagtggggcaggaagttcctcaggaggaagtgcggcgggatccggaagcggtggcgcatcaagtggcgccgcaagtagcagtgccgggtccgcagctggctccgggtcctcccctgttgagatctacaagaccgtgtccgcctggaagcggcagccaatcagagtgctgagcctgttcggcaatattgacaaggaactgaagtctctgggcttcctggaaagcggcagccacagcgagggcggcacactgaagtacgtggaagatgtgaccaacgtggtgcggagagatgtggaaaagtggggacctttcgacctgctgtacggcagcacccagcctctgggcggaagctgcgacaggtgtcctggctggtacatgttccaatttcatagaatcctgcagtacgccagacctagacaggagtctcagcccttcttctggatcttcatggataacctgctgctcacagaggacgaccagatgaccaccgtgcggttcctgcaaacagaggccgtcaccctgcgcgacgtgagatctagagtgctgcagaacgccgtccgggtgtggagcaacatccccggtcttaaaagcaagcacgaggctctgtccccaaaagaggaagagagcctgcagggccacgtgcggaccagatctaagctggccgctcctaaagtggaccccctggtgaagaactgcctgctgcctctgagagagtactttaagtatttcagccagagcagcctgcccctgggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtgtccggctctgaaacccctggaacctccgagagcgccacacctgaaagcagaaccctggtgaccttcaaggacgtgttcgtggacttcacccgcgaggaatggaagctcctggacaccgcccagcaaatcgtgtaccggaacgtgatgctggagaattacaagaacctggtgtctctgggctaccagctgacgaagcctgacgtcatcctgagactggaaaagggagaggagccttaa

SEQ ID NO: 400 - DNA, 5451 bp, synthetic construct
  misc_feature 1..5451: note = synthetic construct
  source 1..5451: mol_type = other DNA
atggccaggaccaaacaaactgccagaaagagcaccggggggaaagcgccccgaaaacagctggcgaccaaagcagcccgcaaaagcgcaccgggaggtgcaagcagtggggcaggaagttcctcaggaggaagtgcggcgggatccggaagcggtggcgcatcaagtggcgccgcaagtagcagtgccagaaccctggtgaccttcaaggacgtgttcgtggacttcaccagagaagaatggaagctgctggataccgctcagcagatcgtgtacagaaacgtgatgctggaaaactacaagaatctggtgtccctgggctaccagctgaccaagcctgacgtgatcctgagactggaaaagggagaggagccttccggctctgaaacccctggaacctccgagagcgccacacctgaaagctcccctgttgagatctacaagaccgtgtccgcctggaagcggcagccaatcagagtgctgagcctgttcggcaatattgacaaggaactgaagtctctgggcttcctggaaagcggcagccacagcgagggcggcacactgaagtacgtggaagatgtgaccaacgtggtgcggagagatgtggaaaagtggggacctttcgacctgctgtacggcagcacccagcctctgggcggaagctgcgacaggtgtcctggctggtacatgttccaatttcatagaatcctgcagtacgccagacctagacaggagtctcagcccttcttctggatcttcatggataacctgctgctcacagaggacgaccagatgaccaccgtgcggttcctgcaaacagaggccgtcaccctgcgcgacgtgagatctagagtgctgcagaacgccgtccgggtgtggagcaacatccccggtcttaaaagcaagcacgaggctctgtccccaaaagaggaagagagcctgcagggccacgtgcggaccagatctaagctggccgctcctaaagtggaccccctggtgaagaactgcctgctgcctctgagagagtactttaagtatttcagccagagcagcctgcccctgggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagcctaagaaaaagcggaaggtgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgaccccaagaagaagcggaaggtgtaa

SEQ ID NO: 401 - RNA, 20 nt, synthetic construct
  misc_feature 1..20: note = synthetic construct
  source 1..20: mol_type = other RNA
gctcccagtcggcaccacag

SEQ ID NO: 402 - RNA, 20 nt, synthetic construct
  misc_feature 1..20: note = synthetic construct
  source 1..20: mol_type = other RNA
gctccgagtcggcaccacag

SEQ ID NO: 403 - DNA, 23 bp, synthetic construct
  misc_feature 1..23: note = synthetic construct
  source 1..23: mol_type = other DNA
gcccagaatcggtctgctgatcc

SEQ ID NO: 404 - DNA, 23 bp, synthetic construct
  misc_feature 1..23: note = synthetic construct
  source 1..23: mol_type = other DNA
gcctagaatcggtctgctgatcc

SEQ ID NO: 405 - DNA, 23 bp, synthetic construct
  misc_feature 1..23: note = synthetic construct
  source 1..23: mol_type = other DNA
gcccaggatcggtctgctgatcc

SEQ ID NO: 406 - DNA, 23 bp, synthetic construct
  misc_feature 1..23: note = synthetic construct
  source 1..23: mol_type = other DNA
gcccacaatcggtctgctgatcc

SEQ ID NO: 407 - DNA, 23 bp, synthetic construct
  misc_feature 1..23: note = synthetic construct
  source 1..23: mol_type = other DNA
gcccagaattggtctgctgatcc

SEQ ID NO: 408 - DNA, 23 bp, synthetic construct
  misc_feature 1..23: note = synthetic construct
  source 1..23: mol_type = other DNA
gcccagaatcggcctgctgatcc

SEQ ID NO: 409 - DNA, 23 bp, synthetic construct
  misc_feature 1..23: note = synthetic construct
  source 1..23: mol_type = other DNA
gcccagaatcgctctgctgatcc

SEQ ID NO: 410 - DNA, 23 bp, synthetic construct
  misc_feature 1..23: note = synthetic construct
  source 1..23: mol_type = other DNA
gcccagaatcggtctgttgatcc

SEQ ID NO: 411 - DNA, 23 bp, synthetic construct
  misc_feature 1..23: note = synthetic construct
  source 1..23: mol_type = other DNA
gcccagaatcggtctcctgatcc

SEQ ID NO: 412 - DNA, 23 bp, synthetic construct
  misc_feature 1..23: note = synthetic construct
  source 1..23: mol_type = other DNA
gcccagaatcggtctgctggtcc

SEQ ID NO: 413 - DNA, 23 bp, synthetic construct
  misc_feature 1..23: note = synthetic construct
  source 1..23: mol_type = other DNA
gcccagaatcggtctgctcatcc

SEQ ID NO: 414 - DNA, 23 bp, synthetic construct
  misc_feature 1..23: note = synthetic construct
  source 1..23: mol_type = other DNA
gcccacaatcggtctgctcatcc

SEQ ID NO: 415 - DNA, 23 bp, synthetic construct
  misc_feature 1..23: note = synthetic construct
  source 1..23: mol_type = other DNA
gcccacaatcgctctgctcatcc

SEQ ID NO: 416 - DNA, 23 bp, synthetic construct
  misc_feature 1..23: note = synthetic construct
  source 1..23: mol_type = other DNA
gcagcagcgttccgtagcttacc

SEQ ID NO: 417 - protein, 102 aa, synthetic construct
  REGION 1..102: note = synthetic construct
CLSYETEILTVEYGLLPIGKIVEKRIECTVYSVDNNGNIYTQPVAQWHDRGEQEVFEYCLEDGSLIRATKDHKFMTVDGQMLPIDEIFERELDLMRVDNLPN

SEQ ID NO: 418 - DNA, 306 bp, synthetic construct
  misc_feature 1..306: note = synthetic construct
  source 1..306: mol_type = other DNA
tgtctgagctacgagaccgagatcctgaccgttgagtacggcctactccccatcggcaagatagttgagaaaagaatcgagtgcaccgtgtacagcgtggacaacaatggcaacatctatacacagcctgtggcccagtggcacgacagaggagagcaggaggtgttcgagtactgcctggaagatggatcactgatcagagccacgaaggatcacaagttcatgaccgtggacggccagatgctgccaatcgacgagatcttcgagcgggagctggacctaatgagagtcgataacctgcctaat

SEQ ID NO: 419 - protein, 36 aa, synthetic construct
  REGION 1..36: note = synthetic construct
IKIATRKYLGKQNVYDIGVGEPHNFALKNGFIASNC

SEQ ID NO: 420 - DNA, 108 bp, synthetic construct
  misc_feature 1..108: note = synthetic construct
  source 1..108: mol_type = other DNA
atcaaaatcgccacccggaagtacctgggcaaacaaaacgtgtatgacatcggcgtgggcgagcctcataattttgctttgaaaaacggcttcatcgctagcaactgc

SEQ ID NO: 421 - DNA, 63 bp, synthetic construct
  misc_feature 1..63: note = synthetic construct
  source 1..63: mol_type = other DNA
ggctctggcgaaggccggggaagcctgctcacttgcggcgacgtggaagagaatccaggccct

SEQ ID NO: 422 - DNA, 57 bp, synthetic construct
  misc_feature 1..57: note = synthetic construct
  source 1..57: mol_type = other DNA
gccacaaacttctctctgctgaagcaggccggcgatgtcgaagaaaatcccggcccc

SEQ ID NO: 423 - protein, 196 aa, synthetic construct
  REGION 1..196: note = synthetic construct
GVPAAMAERPFQCRICMRNFSDRSNLSRHIRTHTGEKPFACDICGRKFALRQDLKRHTKIHTGSQKPFQCRICMRNFSDRSALSRHIRTHTGEKPFACDICGRKFAQSGDLTRHTKIHTGSQKPFQCRICMRNFSRSANLARHIRTHTGEKPFACDICGRKFADSSDRKKHTKIHLRQKDAARGSGGDAKSLTAWS

SEQ ID NO: 424 - DNA, 588 bp, synthetic construct
  misc_feature 1..588: note = synthetic construct
  source 1..588: mol_type = other DNA
ggcgtgcctgccgctatggccgagagacctttccaatgtagaatctgcatgcggaacttctccgatagaagcaacctgtctagacacatcagaacccacacaggcgaaaagccttttgcctgtgacatctgcggaagaaagttcgcactgagacaggacctcaagcggcacaccaagatccacacaggcagccagaaaccattccagtgcagaatctgcatgagaaacttcagcgacagaagcgccctgagcagacatattcggacacatacaggcgagaagcccttcgcctgcgacatctgcggcagaaagttcgcccagagcggcgacctgacaagacacaccaagatccacaccggctctcagaagccctttcagtgccggatctgtatgaggaatttcagccggagcgccaacctggccagacacatccggacccacaccggcgaaaagcctttcgcttgtgatatctgcggcagaaagtttgctgatagcagcgacagaaaaaagcacaccaaaatccacctgcggcagaaagacgccgcccgcggatctggcggagatgccaagagcctgaccgcctggtcc

SEQ ID NO: 425 - protein, 196 aa, synthetic construct
  REGION 1..196: note = synthetic construct
GVPAAMAERPFQCRICMRNFSLQCCLYHHIRTHTGEKPFACDICGRKFADRSNLTRHTKIHTGSQKPFQCRICMRNFSQSSDLSRHIRTHTGEKPFACDICGRKFADRSALARHTKIHTGSQKPFQCRICMRNFSIKHDLHRHIRTHTGEKPFACDICGRKFARSANLTRHTKIHLRQKDAARGSGGDAKSLTAWS

SEQ ID NO: 426 - DNA, 588 bp, synthetic construct
  misc_feature 1..588: note = synthetic construct
  source 1..588: mol_type = other DNA
ggcgtgccagccgccatggccgagcggccttttcagtgcaggatctgcatgcggaactttagcctccagtgctgcctgtaccaccacatccggacccacaccggcgaaaagcctttcgcctgcgacatctgtggaagaaagttcgctgatagaagcaacctgacaagacacaccaagatccacacaggcagccaaaaacctttccagtgccggatctgcatgcgcaacttcagccagagctctgatctgagcagacacatcagaacccacaccggcgagaagcccttcgcttgcgacatctgcggccggaaattcgccgacagaagcgccctggcccggcataccaagatccacaccggaagccagaaacccttccagtgtcggatctgtatgagaaatttctctatcaagcacgacctgcacagacatattagaacacacacaggcgaaaagccttttgcttgtgacatctgcggcagaaagttcgccagatctgccaacctgaccagacacacaaagatccacctgagacagaaggacgccgctagaggcagcggcggagatgccaagtccctgaccgcctggtcc

SEQ ID NO: 427 - protein, 665 aa, synthetic construct
  REGION 1..665: note = synthetic construct
MARTKQTARKSTGGKAPRKQLATKAARKSAPGGASSGAGSSSGGSAAGSGSGGASSGAASSSARTLVTFKDVFVDFTREEWKLLDTAQQIVYRNVMLENYKNLVSLGYQLTKPDVILRLEKGEEPSGSETPGTSESATPESSPVEIYKTVSAWKRQPIRVLSLFGNIDKELKSLGFLESGSHSEGGTLKYVEDVTNVVRRDVEKWGPFDLLYGSTQPLGGSCDRCPGWYMFQFHRILQYARPRQESQPFFWIFMDNLLLTEDDQMTTVRFLQTEAVTLRDVRSRVLQNAVRVWSNIPGLKSKHEALSPKEEESLQGHVRTRSKLAAPKVDPLVKNCLLPLREYFKYFSQSSLPLGGPSSGAPPPSGGSPAGSPTSTEEGTSESATPESGPGTSTEPSEGSAPGSPAGSPTSTEEGTSTEPSEGSAPGTSTEPSEKRTADGSEFESPKKKRKVGVPAAMAERPFQCRICMRNFSDRSNLSRHIRTHTGEKPFACDICGRKFALRQDLKRHTKIHTGSQKPFQCRICMRNFSDRSALSRHIRTHTGEKPFACDICGRKFAQSGDLTRHTKIHTGSQKPFQCRICMRNFSRSANLARHIRTHTGEKPFACDICGRKFADSSDRKKHTKIHLRQKDAARGSGGDAKSLTAWSKRTADGSEFEPKKKRKV

SEQ ID NO: 428 - DNA, 1998 bp, synthetic construct
  misc_feature 1..1998: note = synthetic construct
  source 1..1998: mol_type = other DNA
atggccaggaccaaacaaactgccagaaagagcaccggggggaaagcgccccgaaaacagctggcgaccaaagcagcccgcaaaagcgcaccgggaggtgcaagcagtggggcaggaagttcctcaggaggaagtgcggcgggatccggaagcggtggcgcatcaagtggcgccgcaagtagcagtgccagaaccctggtgaccttcaaggacgtgttcgtggacttcaccagagaagaatggaagctgctggataccgctcagcagatcgtgtacagaaacgtgatgctggaaaactacaagaatctggtgtccctgggctaccagctgaccaagcctgacgtgatcctgagactggaaaagggagaggagccttccggctctgaaacccctggaacctccgagagcgccacacctgaaagctcccctgttgagatctacaagaccgtgtccgcctggaagcggcagccaatcagagtgctgagcctgttcggcaatattgacaaggaactgaagtctctgggcttcctggaaagcggcagccacagcgagggcggcacactgaagtacgtggaagatgtgaccaacgtggtgcggagagatgtggaaaagtggggacctttcgacctgctgtacggcagcacccagcctctgggcggaagctgcgacaggtgtcctggctggtacatgttccaatttcatagaatcctgcagtacgccagacctagacaggagtctcagcccttcttctggatcttcatggataacctgctgctcacagaggacgaccagatgaccaccgtgcggttcctgcaaacagaggccgtcaccctgcgcgacgtgagatctagagtgctgcagaacgccgtccgggtgtggagcaacatccccggtcttaaaagcaagcacgaggctctgtccccaaaagaggaagagagcctgcagggccacgtgcggaccagatctaagctggccgctcctaaagtggaccccctggtgaagaactgcctgctgcctctgagagagtactttaagtatttcagccagagcagcctgcccctgggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagaagcggactgccgatggatctgagtttgagagccctaagaaaaaaagaaaggttggcgtgcctgccgctatggccgagagacctttccaatgtagaatctgcatgcggaacttctccgatagaagcaacctgtctagacacatcagaacccacacaggcgaaaagccttttgcctgtgacatctgcggaagaaagttcgcactgagacaggacctcaagcggcacaccaagatccacacaggcagccagaaaccattccagtgcagaatctgcatgagaaacttcagcgacagaagcgccctgagcagacatattcggacacatacaggcgagaagcccttcgcctgcgacatctgcggcagaaagttcgcccagagcggcgacctgacaagacacaccaagatccacaccggctctcagaagccctttcagtgccggatctgtatgaggaatttcagccggagcgccaacctggccagacacatccggacccacaccggcgaaaagcctttcgcttgtgatatctgcggcagaaagtttgctgatagcagcgacagaaaaaagcacaccaaaatccacctgcggcagaaagacgccgcccgcggatctggcggagatgccaagagcctgaccgcctggtccaagaggaccgccgacggcagcgagttcgagcccaagaaaaagcggaaggtgtaa

SEQ ID NO: 429 - protein, 665 aa, synthetic construct
  REGION 1..665: note = synthetic construct
MARTKQTARKSTGGKAPRKQLATKAARKSAPGGASSGAGSSSGGSAAGSGSGGASSGAASSSARTLVTFKDVFVDFTREEWKLLDTAQQIVYRNVMLENYKNLVSLGYQLTKPDVILRLEKGEEPSGSETPGTSESATPESSPVEIYKTVSAWKRQPIRVLSLFGNIDKELKSLGFLESGSHSEGGTLKYVEDVTNVVRRDVEKWGPFDLLYGSTQPLGGSCDRCPGWYMFQFHRILQYARPRQESQPFFWIFMDNLLLTEDDQMTTVRFLQTEAVTLRDVRSRVLQNAVRVWSNIPGLKSKHEALSPKEEESLQGHVRTRSKLAAPKVDPLVKNCLLPLREYFKYFSQSSLPLGGPSSGAPPPSGGSPAGSPTSTEEGTSESATPESGPGTSTEPSEGSAPGSPAGSPTSTEEGTSTEPSEGSAPGTSTEPSEKRTADGSEFESPKKKRKVGVPAAMAERPFQCRICMRNFSLQCCLYHHIRTHTGEKPFACDICGRKFADRSNLTRHTKIHTGSQKPFQCRICMRNFSQSSDLSRHIRTHTGEKPFACDICGRKFADRSALARHTKIHTGSQKPFQCRICMRNFSIKHDLHRHIRTHTGEKPFACDICGRKFARSANLTRHTKIHLRQKDAARGSGGDAKSLTAWSKRTADGSEFEPKKKRKV

SEQ ID NO: 430 - DNA, 1998 bp, synthetic construct
  misc_feature 1..1998: note = synthetic construct
  source 1..1998: mol_type = other DNA
atggccaggaccaaacaaactgccagaaagagcaccggggggaaagcgccccgaaaacagctggcgaccaaagcagcccgcaaaagcgcaccgggaggtgcaagcagtggggcaggaagttcctcaggaggaagtgcggcgggatccggaagcggtggcgcatcaagtggcgccgcaagtagcagtgccagaaccctggtgaccttcaaggacgtgttcgtggacttcaccagagaagaatggaagctgctggataccgctcagcagatcgtgtacagaaacgtgatgctggaaaactacaagaatctggtgtccctgggctaccagctgaccaagcctgacgtgatcctgagactggaaaagggagaggagccttccggctctgaaacccctggaacctccgagagcgccacacctgaaagctcccctgttgagatctacaagaccgtgtccgcctggaagcggcagccaatcagagtgctgagcctgttcggcaatattgacaaggaactgaagtctctgggcttcctggaaagcggcagccacagcgagggcggcacactgaagtacgtggaagatgtgaccaacgtggtgcggagagatgtggaaaagtggggacctttcgacctgctgtacggcagcacccagcctctgggcggaagctgcgacaggtgtcctggctggtacatgttccaatttcatagaatcctgcagtacgccagacctagacaggagtctcagcccttcttctggatcttcatggataacctgctgctcacagaggacgaccagatgaccaccgtgcggttcctgcaaacagaggccgtcaccctgcgcgacgtgagatctagagtgctgcagaacgccgtccgggtgtggagcaacatccccggtcttaaaagcaagcacgaggctctgtccccaaaagaggaagagagcctgcagggccacgtgcggaccagatctaagctggccgctcctaaagtggaccccctggtgaagaactgcctgctgcctctgagagagtactttaagtatttcagccagagcagcctgcccctgggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagaagcggactgccgatggatctgagtttgagagccctaagaaaaaaagaaaggttggcgtgccagccgccatggccgagcggccttttcagtgcaggatctgcatgcggaactttagcctccagtgctgcctgtaccaccacatccggacccacaccggcgaaaagcctttcgcctgcgacatctgtggaagaaagttcgctgatagaagcaacctgacaagacacaccaagatccacacaggcagccaaaaacctttccagtgccggatctgcatgcgcaacttcagccagagctctgatctgagcagacacatcagaacccacaccggcgagaagcccttcgcttgcgacatctgcggccggaaattcgccgacagaagcgccctggcccggcataccaagatccacaccggaagccagaaacccttccagtgtcggatctgtatgagaaatttctctatcaagcacgacctgcacagacatattagaacacacacaggcgaaaagccttttgcttgtgacatctgcggcagaaagttcgccagatctgccaacctgaccagacacacaaagatccacctgagacagaaggacgccgctagaggcagcggcggagatgccaagtccctgaccgcctggtccaagaggaccgccgacggcagcgagttcgagcccaagaaaaagcggaaggtgtaa

SEQ ID NO: 431 - protein, 843 aa, synthetic construct
  REGION 1..843: note = synthetic construct
MARTKQTARKSTGGKAPRKQLATKAARKSAPGGASSGAGSSSGGSAAGSGSGGASSGAASSSARTLVTFKDVFVDFTREEWKLLDTAQQIVYRNVMLENYKNLVSLGYQLTKPDVILRLEKGEEPSGSETPGTSESATPESSPVEIYKTVSAWKRQPIRVLSLFGNIDKELKSLGFLESGSHSEGGTLKYVEDVTNVVRRDVEKWGPFDLLYGSTQPLGGSCDRCPGWYMFQFHRILQYARPRQESQPFFWIFMDNLLLTEDDQMTTVRFLQTEAVTLRDVRSRVLQNAVRVWSNIPGLKSKHEALSPKEEESLQGHVRTRSKLAAPKVDPLVKNCLLPLREYFKYFSQSSLPLGGPSSGAPPPSGGSPAGSPTSTEEGTSESATPESGPGTSTEPSEGSAPGSPAGSPTSTEEGTSTEPSEGSAPGTSTEPSECLSYETEILTVEYGLLPIGKIVEKRIECTVYSVDNNGNIYTQPVAQWHDRGEQEVFEYCLEDGSLIRATKDHKFMTVDGQMLPIDEIFERELDLMRVDNLPNGSGEGRGSLLTCGDVEENPGPATNFSLLKQAGDVEENPGPIKIATRKYLGKQNVYDIGVGEPHNFALKNGFIASNCKRTADGSEFESPKKKRKVGVPAAMAERPFQCRICMRNFSDRSNLSRHIRTHTGEKPFACDICGRKFALRQDLKRHTKIHTGSQKPFQCRICMRNFSDRSALSRHIRTHTGEKPFACDICGRKFAQSGDLTRHTKIHTGSQKPFQCRICMRNFSRSANLARHIRTHTGEKPFACDICGRKFADSSDRKKHTKIHLRQKDAARGSGGDAKSLTAWSKRTADGSEFEPKKKRKV

SEQ ID NO: 432 - DNA, 2532 bp, synthetic construct
  misc_feature 1..2532: note = synthetic construct
  source 1..2532: mol_type = other DNA
atggccaggaccaaacaaactgccagaaagagcaccggggggaaagcgccccgaaaacagctggcgaccaaagcagcccgcaaaagcgcaccgggaggtgcaagcagtggggcaggaagttcctcaggaggaagtgcggcgggatccggaagcggtggcgcatcaagtggcgccgcaagtagcagtgccagaaccctggtgaccttcaaggacgtgttcgtggacttcaccagagaagaatggaagctgctggataccgctcagcagatcgtgtacagaaacgtgatgctggaaaactacaagaatctggtgtccctgggctaccagctgaccaagcctgacgtgatcctgagactggaaaagggagaggagccttccggctctgaaacccctggaacctccgagagcgccacacctgaaagctcccctgttgagatctacaagaccgtgtccgcctggaagcggcagccaatcagagtgctgagcctgttcggcaatattgacaaggaactgaagtctctgggcttcctggaaagcggcagccacagcgagggcggcacactgaagtacgtggaagatgtgaccaacgtggtgcggagagatgtggaaaagtggggacctttcgacctgctgtacggcagcacccagcctctgggcggaagctgcgacaggtgtcctggctggtacatgttccaatttcatagaatcctgcagtacgccagacctagacaggagtctcagcccttcttctggatcttcatggataacctgctgctcacagaggacgaccagatgaccaccgtgcggttcctgcaaacagaggccgtcaccctgcgcgacgtgagatctagagtgctgcagaacgccgtccgggtgtggagcaacatccccggtcttaaaagcaagcacgaggctctgtccccaaaagaggaagagagcctgcagggccacgtgcggaccagatctaagctggccgctcctaaagtggaccccctggtgaagaactgcctgctgcctctgagagagtactttaagtatttcagccagagcagcctgcccctgggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagtgtctgagctacgagaccgagatcctgaccgttgagtacggcctactccccatcggcaagatagttgagaaaagaatcgagtgcaccgtgtacagcgtggacaacaatggcaacatctatacacagcctgtggcccagtggcacgacagaggagagcaggaggtgttcgagtactgcctggaagatggatcactgatcagagccacgaaggatcacaagttcatgaccgtggacggccagatgctgccaatcgacgagatcttcgagcgggagctggacctaatgagagtcgataacctgcctaatggctctggcgaaggccggggaagcctgctcacttgcggcgacgtggaagagaatccaggccctgccacaaacttctctctgctgaagcaggccggcgatgtcgaagaaaatcccggccccatcaaaatcgccacccggaagtacctgggcaaacaaaacgtgtatgacatcggcgtgggcgagcctcataattttgctttgaaaaacggcttcatcgctagcaactgcaagcggactgccgatggatctgagtttgagagccctaagaaaaaaagaaaggttggcgtgcctgccgctatggccgagagacctttccaatgtagaatctgcatgcggaacttctccgatagaagcaacctgtctagacacatcagaacccacacaggcgaaaagccttttgcctgtgacatctgcggaagaaagttcgcactgagacaggacctcaagcggcacaccaagatccacacaggcagccagaaaccattccagtgcagaatctgcatgagaaacttcagcgacagaagcgccctgagcagacatattcggacacatacaggcgagaagcccttcgcctgcgacatctgcggcagaaagttcgcccagagcggcgacctgacaagacacaccaagatccacaccggctctcagaagccctttcagtgccggatctgtatgaggaatttcagccggagcgccaacctggccagacacatccggacccacaccggcgaaaagcctttcgcttgtgatatctgcggcagaaagtttgctgatagcagcgacagaaaaaagcacaccaaaatccacctgcggcagaaagacgccgcccgcggatctggcggagatgccaagagcctgaccgcctggtccaagaggaccgccgacggcagcgagttcgagcccaagaaaaagcggaaggtgtaa

SEQ ID NO: 433 - protein, 843 aa, synthetic construct
  REGION 1..843: note = synthetic construct
MARTKQTARKSTGGKAPRKQLATKAARKSAPGGASSGAGSSSGGSAAGSGSGGASSGAASSSARTLVTFKDVFVDFTREEWKLLDTAQQIVYRNVMLENYKNLVSLGYQLTKPDVILRLEKGEEPSGSETPGTSESATPESSPVEIYKTVSAWKRQPIRVLSLFGNIDKELKSLGFLESGSHSEGGTLKYVEDVTNVVRRDVEKWGPFDLLYGSTQPLGGSCDRCPGWYMFQFHRILQYARPRQESQPFFWIFMDNLLLTEDDQMTTVRFLQTEAVTLRDVRSRVLQNAVRVWSNIPGLKSKHEALSPKEEESLQGHVRTRSKLAAPKVDPLVKNCLLPLREYFKYFSQSSLPLGGPSSGAPPPSGGSPAGSPTSTEEGTSESATPESGPGTSTEPSEGSAPGSPAGSPTSTEEGTSTEPSEGSAPGTSTEPSECLSYETEILTVEYGLLPIGKIVEKRIECTVYSVDNNGNIYTQPVAQWHDRGEQEVFEYCLEDGSLIRATKDHKFMTVDGQMLPIDEIFERELDLMRVDNLPNGSGEGRGSLLTCGDVEENPGPATNFSLLKQAGDVEENPGPIKIATRKYLGKQNVYDIGVGEPHNFALKNGFIASNCKRTADGSEFESPKKKRKVGVPAAMAERPFQCRICMRNFSLQCCLYHHIRTHTGEKPFACDICGRKFADRSNLTRHTKIHTGSQKPFQCRICMRNFSQSSDLSRHIRTHTGEKPFACDICGRKFADRSALARHTKIHTGSQKPFQCRICMRNFSIKHDLHRHIRTHTGEKPFACDICGRKFARSANLTRHTKIHLRQKDAARGSGGDAKSLTAWSKRTADGSEFEPKKKRKV

SEQ ID NO: 434 - DNA, 2532 bp, synthetic construct
  misc_feature 1..2532: note = synthetic construct
  source 1..2532: mol_type = other DNA
atggccaggaccaaacaaactgccagaaagagcaccggggggaaagcgccccgaaaacagctggcgaccaaagcagcccgcaaaagcgcaccgggaggtgcaagcagtggggcaggaagttcctcaggaggaagtgcggcgggatccggaagcggtggcgcatcaagtggcgccgcaagtagcagtgccagaaccctggtgaccttcaaggacgtgttcgtggacttcaccagagaagaatggaagctgctggataccgctcagcagatcgtgtacagaaacgtgatgctggaaaactacaagaatctggtgtccctgggctaccagctgaccaagcctgacgtgatcctgagactggaaaagggagaggagccttccggctctgaaacccctggaacctccgagagcgccacacctgaaagctcccctgttgagatctacaagaccgtgtccgcctggaagcggcagccaatcagagtgctgagcctgttcggcaatattgacaaggaactgaagtctctgggcttcctggaaagcggcagccacagcgagggcggcacactgaagtacgtggaagatgtgaccaacgtggtgcggagagatgtggaaaagtggggacctttcgacctgctgtacggcagcacccagcctctgggcggaagctgcgacaggtgtcctggctggtacatgttccaatttcatagaatcctgcagtacgccagacctagacaggagtctcagcccttcttctggatcttcatggataacctgctgctcacagaggacgaccagatgaccaccgtgcggttcctgcaaacagaggccgtcaccctgcgcgacgtgagatctagagtgctgcagaacgccgtccgggtgtggagcaacatccccggtcttaaaagcaagcacgaggctctgtccccaaaagaggaagagagcctgcagggccacgtgcggaccagatctaagctggccgctcctaaagtggaccccctggtgaagaactgcctgctgcctctgagagagtactttaagtatttcagccagagcagcctgcccctgggcggcccttctagcggtgctccacctccaagcggcggctcgccagccggcagccctaccagcaccgaggagggcacaagcgagagcgcaacacctgagagcggccccggcacaagcaccgagccttctgaaggaagcgcccctgggagccctgccggcagccccaccagcacagaagagggcacctctaccgagcccagcgagggtagcgcccctggcacaagcacagaaccctctgagtgtctgagctacgagaccgagatcctgaccgttgagtacggcctactccccatcggcaagatagttgagaaaagaatcgagtgcaccgtgtacagcgtggacaacaatggcaacatctatacacagcctgtggcccagtggcacgacagaggagagcaggaggtgttcgagtactgcctggaagatggatcactgatcagagccacgaaggatcacaagttcatgaccgtggacggccagatgctgccaatcgacgagatcttcgagcgggagctggacctaatgagagtcgataacctgcctaatggctctggcgaaggccggggaagcctgctcacttgcggcgacgtggaagagaatccaggccctgccacaaacttctctctgctgaagcaggccggcgatgtcgaagaaaatcccggccccatcaaaatcgccacccggaagtacctgggcaaacaaaacgtgtatgacatcggcgtgggcgagcctcataattttgctttgaaaaacggcttcatcgctagcaactgcaagcggactgccgatggatctgagtttgagagccctaagaaaaaaagaaaggttggcgtgccagccgccatggccgagcggccttttcagtgcaggatctgcatgcggaactttagcctccagtgctgcctgtaccaccacatccggacccacaccggcgaaaagcctttcgcctgcgacatctgtggaagaaagttcgctgatagaagcaacctgacaagacacaccaagatccacacaggcagccaaaaacctttccagtgccggatctgcatgcgcaacttcagccagagctctgatctgagcagacacatcagaacccacaccggcgagaagcccttcgcttgcgacatctgcggccggaaattcgccgacagaagcgccctggcccggcataccaagatccacaccggaagccagaaacccttccagtgtcggatctgtatgagaaatttctctatcaagcacgacctgcacagacatattagaacacacacaggcgaaaagccttttgcttgtgacatctgcggcagaaagttcgccagatctgccaacctgaccagacacacaaagatccacctgagacagaaggacgccgctagaggcagcggcggagatgccaagtccctgaccgcctggtccaagaggaccgccgacggcagcgagttcgagcccaagaaaaagcggaaggtgtaa

SEQ ID NO: 435 - protein, 20 aa, synthetic construct
  REGION 1..20: note = synthetic construct
QCTNYALLKLAGDVESNPGP

SEQ ID NO: 436 - protein, 22 aa, synthetic construct
  REGION 1..22: note = synthetic construct
VKQTLNFDLLKLAGDVESNPGP

SEQ ID NO: 437 - protein, 8 aa, synthetic construct
  REGION 1..8: note = synthetic construct
  SITE 2: note = misc_feature - Xaa can be any naturally occurring amino acid
  SITE 4: note = misc_feature - Xaa can be any naturally occurring amino acid
DXEXNPGP

SEQ ID NO: 438 - DNA, 18 bp, synthetic construct
  source 1..18: mol_type = other DNA
tccgcccgcgagcgccgc

SEQ ID NO: 439 - DNA, 18 bp, synthetic construct
  source 1..18: mol_type = other DNA
tcgcgggcggaggtcggc

SEQ ID NO: 440 - DNA, 18 bp, synthetic construct
  source 1..18: mol_type = other DNA
tcggcgcggggaccaatt

SEQ ID NO: 441 - DNA, 18 bp, synthetic construct
  source 1..18: mol_type = other DNA
tggtccccgcgccgacct

SEQ ID NO: 442 - DNA, 18 bp, synthetic construct
  source 1..18: mol_type = other DNA
ttggtccccgcgccgacc

SEQ ID NO: 443 - DNA, 18 bp, synthetic construct
  source 1..18: mol_type = other DNA
tcgcggcgccgcggctgt

SEQ ID NO: 444 - DNA, 18 bp, synthetic construct
  source 1..18: mol_type = other DNA
tgggaggaacgcgggcgg

SEQ ID NO: 445 - DNA, 18 bp, synthetic construct
  source 1..18: mol_type = other DNA
tcagcgactggctcggag

SEQ ID NO: 446 - DNA, 18 bp, synthetic construct
  source 1..18: mol_type = other DNA
tcggtctgctgatccgac

SEQ ID NO: 447 - DNA, 18 bp, synthetic construct
  source 1..18: mol_type = other DNA
tcccggctcccccgcgtt

SEQ ID NO: 448 - DNA, 18 bp, synthetic construct
  source 1..18: mol_type = other DNA
tgggcgctgcgtcgcatc

SEQ ID NO: 449 - DNA, 18 bp, synthetic construct
  source 1..18: mol_type = other DNA
tgcgacgcagcgcccaga

SEQ ID NO: 450 - DNA, 18 bp, synthetic construct
  source 1..18: mol_type = other DNA
tcacgccccgcccctcgc

SEQ ID NO: 451 - DNA, 18 bp, synthetic construct
  source 1..18: mol_type = other DNA
tctctcgcgggggggtgg

SEQ ID NO: 452 - DNA, 18 bp, synthetic construct
  source 1..18: mol_type = other DNA
tccggagcggtgactcat

SEQ ID NO: 453 - DNA, 18 bp, synthetic construct
  source 1..18: mol_type = other DNA
tccgtcgtcaagctcggc

SEQ ID NO: 454 - protein, 763 aa, synthetic construct
GIHRGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPDQVVAIASHDGGKQALETVQRLLPVLCQDHGFSQADIVKIAGGGGAQALQAVLELEPTLRERGLTPQQVVAIANNHGGKQALETVQRLLPVLCQAHGLTPDQVVAIASHDGGKQALETVQRLLPVLCQDHGLTPAQVVAIASHDGGKQALETVQALLPVLCQDHGLTPDQVVAIANGGGKQALETVQRLLPVLCQAHGLTPEQVVAIASNHGGKQALETVQRLLPVLCQAHGFSQADIVKIAGGGGAQALQAVLELEPTLRERGLTPDQVVAIASNHGGKQALETVQRLLPVLCQDHGLTPAQVVAIASNIGGKQALETVQALLPVLCQAHGLTPDQVVAIANNHGGKQALETVQRLLPVLCQAHGLTPDQVVAIANGGGKQALETVQRLLPVLCQAHGLTPEQVVAIASNHGGKQALETVQRLLPVLCQAHGLTPQQVVAIANHDGGKQALETVQRLLPVLCQAHGYSRADIVKIAGGGGAQALKAVVMHGPTLCERGLTPDQVVAIANNHGGKQALETVQRLLPVLCQDHGLTPQQVVAIASHDGGRPALESIVAQLSRPDPALAALTNDHLVALACLGGRPALDAVKKGLPHAPALIKRTNRRIPERTSHRVA

SEQ ID NO: 455 - protein, 764 aa, synthetic construct
GIHRGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPDQVVAIASGGGKQALETVQRLLPVLCQDHGFSQADIVKIAGNHGGAQALQAVLELEPTLRERGLTPQQVVAIANGGGKQALETVQRLLPVLCQAHGLTPDQVVAIASNHGGKQALETVQRLLPVLCQDHGLTPAQVVAIASNHGGKQALETVQALLPVLCQDHGLTPDQVVAIANNHGGKQALETVQRLLPVLCQAHGLTPEQVVAIASGGGKQALETVQRLLPVLCQAHGFSQADIVKIAGNHGGAQALQAVLELEPTLRERGLTPDQVVAIASNHGGKQALETVQRLLPVLCQDHGLTPAQVVAIASNIGGKQALETVQALLPVLCQAHGLTPDQVVAIANNHGGKQALETVQRLLPVLCQAHGLTPDQVVAIANNHGGKQALETVQRLLPVLCQAHGLTPEQVVAIASNGGGKQALETVQRLLPVLCQAHGLTPQQVVAIANGGGKQALETVQRLLPVLCQAHGYSRADIVKIAGNHGGAQALKAVVMHGPTLCERGLTPDQVVAIANNHGGKQALETVQRLLPVLCQDHGLTPQQVVAIASHDGGRPALESIVAQLSRPDPALAALTNDHLVALACLGGRPALDAVKKGLPHAPALIKRTNRRIPERTSHRVA

SEQ ID NO: 456 - protein, 765 aa, synthetic construct
GIHRGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPDQVVAIASGGGKQALETVQRLLPVLCQDHGFSQADIVKIAGNHGGAQALQAVLELEPTLRERGLTPQQVVAIANNHGGKQALETVQRLLPVLCQAHGLTPDQVVAIASGGGKQALETVQRLLPVLCQDHGLTPAQVVAIASNHGGKQALETVQALLPVLCQDHGLTPDQVVAIANGGGKQALETVQRLLPVLCQAHGLTPEQVVAIASNHGGKQALETVQRLLPVLCQAHGFSQADIVKIAGNHGGAQALQAVLELEPTLRERGLTPDQVVAIASNHGGKQALETVQRLLPVLCQDHGLTPAQVVAIASNHGGKQALETVQALLPVLCQAHGLTPDQVVAIANNIGGKQALETVQRLLPVLCQAHGLTPDQVVAIANHDGGKQALETVQRLLPVLCQAHGLTPEQVVAIASHDGGKQALETVQRLLPVLCQAHGLTPQQVVAIANNIGGKQALETVQRLLPVLCQAHGYSRADIVKIAGNIGGAQALKAVVMHGPTLCERGLTPDQVVAIANNGGGKQALETVQRLLPVLCQDHGLTPQQVVAIASNGGGRPALESIVAQLSRPDPALAALTNDHLVALACLGGRPALDAVKKGLPHAPALIKRTNRRIPERTSHRVA

SEQ ID NO: 457 - protein, 765 aa, synthetic construct
GIHRGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPDQVVAIASNHGGKQALETVQRLLPVLCQDHGFSQADIVKIAGNHGGAQALQAVLELEPTLRERGLTPQQVVAIANNGGGKQALETVQRLLPVLCQAHGLTPDQVVAIASHDGGKQALETVQRLLPVLCQDHGLTPAQVVAIASHDGGKQALETVQALLPVLCQDHGLTPDQVVAIANHDGGKQALETVQRLLPVLCQAHGLTPEQVVAIASGGGKQALETVQRLLPVLCQAHGFSQADIVKIAGNHGGAQALQAVLELEPTLRERGLTPDQVVAIASGGGKQALETVQRLLPVLCQDHGLTPAQVVAIASNHGGKQALETVQALLPVLCQAHGLTPDQVVAIANHDGGKQALETVQRLLPVLCQAHGLTPDQVVAIANGGGKQALETVQRLLPVLCQAHGLTPEQVVAIASNHGGKQALETVQRLLPVLCQAHGLTPQQVVAIANNIGGKQALETVQRLLPVLCQAHGYSRADIVKIAGHDGGAQALKAVVMHGPTLCERGLTPDQVVAIANHDGGKQALETVQRLLPVLCQDHGLTPQQVVAIASNGGGRPALESIVAQLSRPDPALAALTNDHLVALACLGGRPALDAVKKGLPHAPALIKRTNRRIPERTSHRVA

SEQ ID NO: 458 - protein, 765 aa, synthetic construct
GIHRGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPDQVVAIASNGGGKQALETVQRLLPVLCQDHGFSQADIVKIAGNHGGAQALQAVLELEPTLRERGLTPQQVVAIANNHGGKQALETVQRLLPVLCQAHGLTPDQVVAIASNGGGKQALETVQRLLPVLCQDHGLTPAQVVAIASHDGGKQALETVQALLPVLCQDHGLTPDQVVAIANHDGGKQALETVQRLLPVLCQAHGLTPEQVVAIASHDGGKQALETVQRLLPVLCQAHGFSQADIVKIAGGGGAQALQAVLELEPTLRERGLTPDQVVAIASNHGGKQALETVQRLLPVLCQDHGLTPAQVVAIASGGGKQALETVQALLPVLCQAHGLTPDQVVAIANNHGGKQALETVQRLLPVLCQAHGLTPDQVVAIANHDGGKQALETVQRLLPVLCQAHGLTPEQVVAIASGGGKQALETVQRLLPVLCQAHGLTPQQVVAIANNHGGKQALETVQRLLPVLCQAHGYSRADIVKIAGNIGGAQALKAVVMHGPTLCERGLTPDQVVAIANHDGGKQALETVQRLLPVLCQDHGLTPQQVVAIASHDGGRPALESIVAQLSRPDPALAALTNDHLVALACLGGRPALDAVKKGLPHAPALIKRTNRRIPERTSHRVA

SEQ ID NO: 459 - protein, 763 aa, synthetic construct
GIHRGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPDQVVAIASGGGKQALETVQRLLPVLCQDHGFSQADIVKIAGNHGGAQALQAVLELEPTLRERGLTPQQVVAIANGGGKQALETVQRLLPVLCQAHGLTPDQVVAIASNHGGKQALETVQRLLPVLCQDHGLTPAQVVAIASNHGGKQALETVQALLPVLCQDHGLTPDQVVAIANGGGKQALETVQRLLPVLCQAHGLTPEQVVAIASNHGGKQALETVQRLLPVLCQAHGFSQADIVKIAGHDGGAQALQAVLELEPTLRERGLTPDQVVAIASGGGKQALETVQRLLPVLCQDHGLTPAQVVAIASNHGGKQALETVQALLPVLCQAHGLTPDQVVAIANGGGKQALETVQRLLPVLCQAHGLTPDQVVAIANNHGGKQALETVQRLLPVLCQAHGLTPEQVVAIASNHGGKQALETVQRLLPVLCQAHGLTPQQVVAIANHDGGKQALETVQRLLPVLCQAHGYSRADIVKIAGNGGGAQALKAVVMHGPTLCERGLTPDQVVAIANNHGGKQALETVQRLLPVLCQDHGLTPQQVVAIASNGGGRPALESIVAQLSRPDPALAALTNDHLVALACLGGRPALDAVKKGLPHAPALIKRTNRRIPERTSHRVA

SEQ ID NO: 460 - protein, 765 aa, synthetic construct
GIHRGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPDQVVAIASNHGGKQALETVQRLLPVLCQDHGFSQADIVKIAGNHGGAQALQAVLELEPTLRERGLTPQQVVAIANNHGGKQALETVQRLLPVLCQAHGLTPDQVVAIASNIGGKQALETVQRLLPVLCQDHGLTPAQVVAIASNHGGKQALETVQALLPVLCQDHGLTPDQVVAIANNHGGKQALETVQRLLPVLCQAHGLTPEQVVAIASNIGGKQALETVQRLLPVLCQAHGFSQADIVKIAGNIGGAQALQAVLELEPTLRERGLTPDQVVAIASGGGKQALETVQRLLPVLCQDHGLTPAQVVAIASNHGGKQALETVQALLPVLCQAHGLTPDQVVAIANGGGKQALETVQRLLPVLCQAHGLTPDQVVAIANNHGGKQALETVQRLLPVLCQAHGLTPEQVVAIASNHGGKQALETVQRLLPVLCQAHGLTPQQVVAIANNHGGKQALETVQRLLPVLCQAHGYSRADIVKIAGGGGAQALKAVVMHGPTLCERGLTPDQVVAIANNHGGKQALETVQRLLPVLCQDHGLTPQQVVAIASNHGGRPALESIVAQLSRPDPALAALTNDHLVALACLGGRPALDAVKKGLPHAPALIKRTNRRIPERTSHRVA

SEQ ID NO: 461 - protein, 766 aa, synthetic construct
GIHRGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPDQVVAIASHDGGKQALETVQRLLPVLCQDHGFSQADIVKIAGNIGGAQALQAVLELEPTLRERGLTPQQVVAIANNHGGKQALETVQRLLPVLCQAHGLTPDQVVAIASGGGKQALETVQRLLPVLCQDHGLTPAQVVAIASNHGGKQALETVQALLPVLCQDHGLTPDQVVAIANNIGGKQALETVQRLLPVLCQAHGLTPEQVVAIASHDGGKQALETVQRLLPVLCQAHGFSQADIVKIAGNGGGAQALQAVLELEPTLRERGLTPDQVVAIASNHGGKQALETVQRLLPVLCQDHGLTPAQVVAIASNHGGKQALETVQALLPVLCQAHGLTPDQVVAIANHDGGKQALETVQRLLPVLCQAHGLTPDQVVAIANNGGGKQALETVQRLLPVLCQAHGLTPEQVVAIASGGGKQALETVQRLLPVLCQAHGLTPQQVVAIANNHGGKQALETVQRLLPVLCQAHGYSRADIVKIAGNHGGAQALKAVVMHGPTLCERGLTPDQVVAIANNIGGKQALETVQRLLPVLCQDHGLTPQQVVAIASNHGGRPALESIVAQLSRPDPALAALTNDHLVALACLGGRPALDAVKKGLPHAPALIKRTNRRIPERTSHRVA

SEQ ID NO: 462 - protein, 766 aa, synthetic construct
GIHRGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPDQVVAIASGGGKQALETVQRLLPVLCQDHGFSQADIVKIAGNHGGAQALQAVLELEPTLRERGLTPQQVVAIANNHGGKQALETVQRLLPVLCQAHGLTPDQVVAIASNGGGKQALETVQRLLPVLCQDHGLTPAQVVAIASHDGGKQALETVQALLPVLCQDHGLTPDQVVAIANNGGGKQALETVQRLLPVLCQAHGLTPEQVVAIASNHGGKQALETVQRLLPVLCQAHGFSQADIVKIAGHDGGAQALQAVLELEPTLRERGLTPDQVVAIASNGGGKQALETVQRLLPVLCQDHGLTPAQVVAIASNHGGKQALETVQALLPVLCQAHGLTPDQVVAIANNIGGKQALETVQRLLPVLCQAHGLTPDQVVAIANNGGGKQALETVQRLLPVLCQAHGLTPEQVVAIASHDGGKQALETVQRLLPVLCQAHGLTPQQVVAIANGGGKQALETVQRLLPVLCQAHGYSRADIVKIAGNHGGAQALKAVVMHGPTLCERGLTPDQVVAIANNIGGKQALETVQRLLPVLCQDHGLTPQQVVAIASHDGGRPALESIVAQLSRPDPALAALTNDHLVALACLGGRPALDAVKKGLPHAPALIKRTNRRIPERTSHRVA

SEQ ID NO: 463 - protein, 765 aa, synthetic construct
GIHRGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPDQVVAIASHDGGKQALETVQRLLPVLCQDHGFSQADIVKIAGHDGGAQALQAVLELEPTLRERGLTPQQVVAIANGGGKQALETVQRLLPVLCQAHGLTPDQVVAIASNHGGKQALETVQRLLPVLCQDHGLTPAQVVAIASNHGGKQALETVQALLPVLCQDHGLTPDQVVAIANHDGGKQALETVQRLLPVLCQAHGLTPEQVVAIASNGGGKQALETVQRLLPVLCQAHGFSQADIVKIAGHDGGAQALQAVLELEPTLRERGLTPDQVVAIASHDGGKQALETVQRLLPVLCQDHGLTPAQVVAIASHDGGKQALETVQALLPVLCQAHGLTPDQVVAIANHDGGKQALETVQRLLPVLCQAHGLTPDQVVAIANGGGKQALETVQRLLPVLCQAHGLTPEQVVAIASNHGGKQALETVQRLLPVLCQAHGLTPQQVVAIANGGGKQALETVQRLLPVLCQAHGYSRADIVKIAGNHGGAQALKAVVMHGPTLCERGLTPDQVVAIANNGGGKQALETVQRLLPVLCQDHGLTPQQVVAIASNGGGRPALESIVAQLSRPDPALAALTNDHLVALACLGGRPALDAVKKGLPHAPALIKRTNRRIPERTSHRVA

SEQ ID NO: 464 - protein, 765 aa, synthetic construct
GIHRGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPDQVVAIASNHGGKQALETVQRLLPVLCQDHGFSQADIVKIAGNHGGAQALQAVLELEPTLRERGLTPQQVVAIANNHGGKQALETVQRLLPVLCQAHGLTPDQVVAIASGGGKQALETVQRLLPVLCQDHGLTPAQVVAIASNHGGKQALETVQALLPVLCQDHGLTPDQVVAIANHDGGKQALETVQRLLPVLCQAHGLTPEQVVAIASNGGGKQALETVQRLLPVLCQAHGFSQADIVKIAGNHGGAQALQAVLELEPTLRERGLTPDQVVAIASGGGKQALETVQRLLPVLCQDHGLTPAQVVAIASNHGGKQALETVQALLPVLCQAHGLTPDQVVAIANNGGGKQALETVQRLLPVLCQAHGLTPDQVVAIANGGGKQALETVQRLLPVLCQAHGLTPEQVVAIASNHGGKQALETVQRLLPVLCQAHGLTPQQVVAIANHDGGKQALETVQRLLPVLCQAHGYSRADIVKIAGNIGGAQALKAVVMHGPTLCERGLTPDQVVAIANNGGGKQALETVQRLLPVLCQDHGLTPQQVVAIASHDGGRPALESIVAQLSRPDPALAALTNDHLVALACLGGRPALDAVKKGLPHAPALIKRTNRRIPERTSHRVA

SEQ ID NO: 465 - protein, 765 aa, synthetic construct
GIHRGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPDQVVAIASNHGGKQALETVQRLLPVLCQDHGFSQADIVKIAGGGGAQALQAVLELEPTLRERGLTPQQVVAIANNHGGKQALETVQRLLPVLCQAHGLTPDQVVAIASNIGGKQALETVQRLLPVLCQDHGLTPAQVVAIASGGGKQALETVQALLPVLCQDHGLTPDQVVAIANNHGGKQALETVQRLLPVLCQAHGLTPEQVVAIASHDGGKQALETVQRLLPVLCQAHGFSQADIVKIAGNIGGAQALQAVLELEPTLRERGLTPDQVVAIASNHGGKQALETVQRLLPVLCQDHGLTPAQVVAIASGGGKQALETVQALLPVLCQAHGLTPDQVVAIANNHGGKQALETVQRLLPVLCQAHGLTPDQVVAIANHDGGKQALETVQRLLPVLCQAHGLTPEQVVAIASHDGGKQALETVQRLLPVLCQAHGLTPQQVVAIANHDGGKQALETVQRLLPVLCQAHGYSRADIVKIAGNIGGAQALKAVVMHGPTLCERGLTPDQVVAIANNHGGKQALETVQRLLPVLCQDHGLTPQQVVAIASNIGGRPALESIVAQLSRPDPALAALTNDHLVALACLGGRPALDAVKKGLPHAPALIKRTNRRIPERTSHRVA

SEQ ID NO: 466 - protein, 765 aa, synthetic construct
GIHRGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPDQVVAIASHDGGKQALETVQRLLPVLCQDHGFSQADIVKIAGNIGGAQALQAVLELEPTLRERGLTPQQVVAIANGGGKQALETVQRLLPVLCQAHGLTPDQVVAIASNHGGKQALETVQRLLPVLCQDHGLTPAQVVAIASHDGGKQALETVQALLPVLCQDHGLTPDQVVAIANHDGGKQALETVQRLLPVLCQAHGLTPEQVVAIASHDGGKQALETVQRLLPVLCQAHGFSQADIVKIAGGGGAQALQAVLELEPTLRERGLTPDQVVAIASNHGGKQALETVQRLLPVLCQDHGLTPAQVVAIASHDGGKQALETVQALLPVLCQAHGLTPDQVVAIANHDGGKQALETVQRLLPVLCQAHGLTPDQVVAIANHDGGKQALETVQRLLPVLCQAHGLTPEQVVAIASHDGGKQALETVQRLLPVLCQAHGLTPQQVVAIANNGGGKQALETVQRLLPVLCQAHGYSRADIVKIAGGGGAQALKAVVMHGPTLCERGLTPDQVVAIANNHGGKQALETVQRLLPVLCQDHGLTPQQVVAIASHDGGRPALESIVAQLSRPDPALAALTNDHLVALACLGGRPALDAVKKGLPHAPALIKRTNRRIPERTSHRVA

SEQ ID NO: 467 - protein, 766 aa, synthetic construct
GIHRGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPDQVVAIASHDGGKQALETVQRLLPVLCQDHGFSQADIVKIAGNGGGAQALQAVLELEPTLRERGLTPQQVVAIANHDGGKQALETVQRLLPVLCQAHGLTPDQVVAIASNGGGKQALETVQRLLPVLCQDHGLTPAQVVAIASGGGKQALETVQALLPVLCQDHGLTPDQVVAIANNHGGKQALETVQRLLPVLCQAHGLTPEQVVAIASGGGKQALETVQRLLPVLCQAHGFSQADIVKIAGNHGGAQALQAVLELEPTLRERGLTPDQVVAIASNHGGKQALETVQRLLPVLCQDHGLTPAQVVAIASNHGGKQALETVQALLPVLCQAHGLTPDQVVAIANNHGGKQALETVQRLLPVLCQAHGLTPDQVVAIANNHGGKQALETVQRLLPVLCQAHGLTPEQVVAIASNHGGKQALETVQRLLPVLCQAHGLTPQQVVAIANNHGGKQALETVQRLLPVLCQAHGYSRADIVKIAGNGGGAQALKAVVMHGPTLCERGLTPDQVVAIANNHGGKQALETVQRLLPVLCQDHGLTPQQVVAIASNHGGRPALESIVAQLSRPDPALAALTNDHLVALACLGGRPALDAVKKGLPHAPALIKRTNRRIPERTSHRVA

SEQ ID NO: 468 - protein, 766 aa, synthetic construct
GIHRGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPDQVVAIASHDGGKQALETVQRLLPVLCQDHGFSQADIVKIAGGGGAQALQAVLELEPTLRERGLTPQQVVAIANNHGGKQALETVQRLLPVLCQAHGLTPDQVVAIASNHGGKQALETVQRLLPVLCQDHGLTPAQVVAIASNIGGKQALETVQALLPVLCQDHGLTPDQVVAIANNHGGKQALETVQRLLPVLCQAHGLTPEQVVAIASGGGKQALETVQRLLPVLCQAHGFSQADIVKIAGNHGGAQALQAVLELEPTLRERGLTPDQVVAIASNHGGKQALETVQRLLPVLCQDHGLTPAQVVAIASNGGGKQALETVQALLPVLCQAHGLTPDQVVAIANNHGGKQALETVQRLLPVLCQAHGLTPDQVVAIANNIGGKQALETVQRLLPVLCQAHGLTPEQVVAIASHDGGKQALETVQRLLPVLCQAHGLTPQQVVAIANNGGGKQALETVQRLLPVLCQAHGYSRADIVKIAGHDGGAQALKAVVMHGPTLCERGLTPDQVVAIANNIGGKQALETVQRLLPVLCQDHGLTPQQVVAIASNGGGRPALESIVAQLSRPDPALAALTNDHLVALACLGGRPALDAVKKGLPHAPALIKRTNRRIPERTSHRVA

SEQ ID NO: 469 - protein, 765 aa, synthetic construct
GIHRGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPDQVVAIASHDGGKQALETVQRLLPVLCQDHGFSQADIVKIAGGGGAQALQAVLELEPTLRERGLTPQQVVAIANNHGGKQALETVQRLLPVLCQAHGLTPDQVVAIASNGGGKQALETVQRLLPVLCQDHGLTPAQVVAIASGGGKQALETVQALLPVLCQDHGLTPDQVVAIANNHGGKQALETVQRLLPVLCQAHGLTPEQVVAIASNGGGKQALETVQRLLPVLCQAHGFSQADIVKIAGHDGGAQALQAVLELEPTLRERGLTPDQVVAIASNIGGKQALETVQRLLPVLCQDHGLTPAQVVAIASNIGGKQALETVQALLPVLCQAHGLTPDQVVAIANNHGGKQALETVQRLLPVLCQAHGLTPDQVVAIANHDGGKQALETVQRLLPVLCQAHGLTPEQVVAIASNGGGKQALETVQRLLPVLCQAHGLTPQQVVAIANGGGKQALETVQRLLPVLCQAHGYSRADIVKIAGNHGGAQALKAVVMHGPTLCERGLTPDQVVAIANNHGGKQALETVQRLLPVLCQDHGLTPQQVVAIASHDGGRPALESIVAQLSRPDPALAALTNDHLVALACLGGRPALDAVKKGLPHAPALIKRTNRRIPERTSHRVA

SEQ ID NO: 470 - protein, 1232 aa, synthetic construct
MARTKQTARKSTGGKAPRKQLATKAARKSAPGGASSGAGSSSGGSAAGSGSGGASSGAASSSARTLVTFKDVFVDFTREEWKLLDTAQQIVYRNVMLENYKNLVSLGYQLTKPDVILRLEKGEEPSGSETPGTSESATPESSPVEIYKTVSAWKRQPIRVLSLFGNIDKELKSLGFLESGSHSEGGTLKYVEDVTNVVRRDVEKWGPFDLLYGSTQPLGGSCDRCPGWYMFQFHRILQYARPRQESQPFFWIFMDNLLLTEDDQMTTVRFLQTEAVTLRDVRSRVLQNAVRVWSNIPGLKSKHEALSPKEEESLQGHVRTRSKLAAPKVDPLVKNCLLPLREYFKYFSQSSLPLGGPSSGAPPPSGGSPAGSPTSTEEGTSESATPESGPGTSTEPSEGSAPGSPAGSPTSTEEGTSTEPSEGSAPGTSTEPSEKRTADGSEFESPKKKRKVGIHRGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPDQVVAIASHDGGKQALETVQRLLPVLCQDHGFSQADIVKIAGGGGAQALQAVLELEPTLRERGLTPQQVVAIANNHGGKQALETVQRLLPVLCQAHGLTPDQVVAIASHDGGKQALETVQRLLPVLCQDHGLTPAQVVAIASHDGGKQALETVQALLPVLCQDHGLTPDQVVAIANGGGKQALETVQRLLPVLCQAHGLTPEQVVAIASNHGGKQALETVQRLLPVLCQAHGFSQADIVKIAGGGGAQALQAVLELEPTLRERGLTPDQVVAIASNHGGKQALETVQRLLPVLCQDHGLTPAQVVAIASNIGGKQALETVQALLPVLCQAHGLTPDQVVAIANNHGGKQALETVQRLLPVLCQAHGLTPDQVVAIANGGGKQALETVQRLLPVLCQAHGLTPEQVVAIASNHGGKQALETVQRLLPVLCQAHGLTPQQVVAIANHDGGKQALETVQRLLPVLCQAHGYSRADIVKIAGGGGAQALKAVVMHGPTLCERGLTPDQVVAIANNHGGKQALETVQRLLPVLCQDHGLTPQQVVAIASHDGGRPALESIVAQLSRPDPALAALTNDHLVALACLGGRPALDAVKKGLPHAPALIKRTNRRIPERTSHRVAKRTADGSEFEPKKKRKV

SEQ ID NO: 471 - protein, 1233 aa, synthetic construct
MARTKQTARKSTGGKAPRKQLATKAARKSAPGGASSGAGSSSGGSAAGSGSGGASSGAASSSARTLVTFKDVFVDFTREEWKLLDTAQQIVYRNVMLENYKNLVSLGYQLTKPDVILRLEKGEEPSGSETPGTSESATPESSPVEIYKTVSAWKRQPIRVLSLFGNIDKELKSLGFLESGSHSEGGTLKYVEDVTNVVRRDVEKWGPFDLLYGSTQPLGGSCDRCPGWYMFQFHRILQYARPRQESQPFFWIFMDNLLLTEDDQMTTVRFLQTEAVTLRDVRSRVLQNAVRVWSNIPGLKSKHEALSPKEEESLQGHVRTRSKLAAPKVDPLVKNCLLPLREYFKYFSQSSLPLGGPSSGAPPPSGGSPAGSPTSTEEGTSESATPESGPGTSTEPSEGSAPGSPAGSPTSTEEGTSTEPSEGSAPGTSTEPSEKRTADGSEFESPKKKRKVGIHRGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPDQVVAIASGGGKQALETVQRLLPVLCQDHGFSQADIVKIAGNHGGAQALQAVLELEPTLRERGLTPQQVVAIANGGGKQALETVQRLLPVLCQAHGLTPDQVVAIASNHGGKQALETVQRLLPVLCQDHGLTPAQVVAIASNHGGKQALETVQALLPVLCQDHGLTPDQVVAIANNHGGKQALETVQRLLPVLCQAHGLTPEQVVAIASGGGKQALETVQRLLPVLCQAHGFSQADIVKIAGNHGGAQALQAVLELEPTLRERGLTPDQVVAIASNHGGKQALETVQRLLPVLCQDHGLTPAQVVAIASNIGGKQALETVQALLPVLCQAHGLTPDQVVAIANNHGGKQALETVQRLLPVLCQAHGLTPDQVVAIANNHGGKQALETVQRLLPVLCQAHGLTPEQVVAIASNGGGKQALETVQRLLPVLCQAHGLTPQQVVAIANGGGKQALETVQRLLPVLCQAHGYSRADIVKIAGNHGGAQALKAVVMHGPTLCERGLTPDQVVAIANNHGGKQALETVQRLLPVLCQDHGLTPQQVVAIASHDGGRPALESIVAQLSRPDPALAALTNDHLVALACLGGRPALDAVKKGLPHAPALIKRTNRRIPERTSHRVAKRTADGSEFEPKKKRKV

SEQ ID NO: 472 - protein, 1217 aa, synthetic construct
MARTKQTARKSTGGKAPRKQLATKAARKSAPGGASSGAGSSSGGSAAGSGSGGASSGAASSSARTLVTFKDVFVDFTREEWKLLDTAQQIVYRNVMLENYKNLVSLGYQLTKPDVILRLEKGEEPSGSETPGTSESATPESSPVEIYKTVSAWKRQPIRVLSLFGNIDKELKSLGFLESGSHSEGGTLKYVEDVTNVVRRDVEKWGPFDLLYGSTQPLGGSCDRCPGWYMFQFHRILQYARPRQESQPFFWIFMDNLLLTEDDQMTTVRFLQTEAVTLRDVRSRVLQNAVRVWSNIPGLKSKHEALSPKEEESLQGHVRTRSKLAAPKVDPLVKNCLLPLREYFKYFSQSSLPLGGPSSGAPPPSGGSPAGSPTSTEEGTSESATPESGPGTSTEPSEGSAPGSPAGSPTSTEEGTSTEPSEGSAPGTSTEPSEKRTADGSEFESPKKKRKVGIHRGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPDQVVAIASGGGKQALETVQRLLPVLCQDHGFSQADIVKIAGNHGGAQALQAVLELEPTLRERGLTPQQVVAIANNHGGKQALETVQRLLPVLCQAHGLTPDQVVAIASGGGKQALETVQRLLPVLCQDHGLTPAQVVAIASNHGGKQALETVQALLPVLCQDHGLTPDQVVAIANGGGKQALETVQRLLPVLCQAHGLTPEQVVAIASNHGGKQALETVQRLLPVLCQAHGFSQADIVKIAGNHGGAQALQAVLELEPTLRERGLTPDQVVAIASNHGGKQALETVQRLLPVLCQDHGLTPAQVVAIASNHGGKQALETVQALLPVLCQAHGLTPDQVVAIANNIGGKQALETVQRLLPVLCQAHGLTPDQVVAIANHDGGKQALETVQRLLPVLCQAHGLTPEQVVAIASHDGGKQALETVQRLLPVLCQAHGLTPQQVVAIANNIGGKQALETVQRLLPVLCQAHGYSRADIVKIAGNIGGAQALKAVVMHGPTLCERGLTPDQVVAIANNGGGKQALETVQRLLPVLCQDHGLTPQQVVAIASNGGGRPALESIVAQLSRPDPALAALTNDHLVALACLGGRPALDAVKKGLPHAPALIKRTNRRIPERTSHRVA

SEQ ID NO: 473 - protein, 1234 aa, synthetic construct
MARTKQTARKSTGGKAPRKQLATKAARKSAPGGASSGAGSSSGGSAAGSGSGGASSGAASSSARTLVTFKDVFVDFTREEWKLLDTAQQIVYRNVMLENYKNLVSLGYQLTKPDVILRLEKGEEPSGSETPGTSESATPESSPVEIYKTVSAWKRQPIRVLSLFGNIDKELKSLGFLESGSHSEGGTLKYVEDVTNVVRRDVEKWGPFDLLYGSTQPLGGSCDRCPGWYMFQFHRILQYARPRQESQPFFWIFMDNLLLTEDDQMTTVRFLQTEAVTLRDVRSRVLQNAVRVWSNIPGLKSKHEALSPKEEESLQGHVRTRSKLAAPKVDPLVKNCLLPLREYFKYFSQSSLPLGGPSSGAPPPSGGSPAGSPTSTEEGTSESATPESGPGTSTEPSEGSAPGSPAGSPTSTEEGTSTEPSEGSAPGTSTEPSEKRTADGSEFESPKKKRKVGIHRGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPDQVVAIASNHGGKQALETVQRLLPVLCQDHGFSQADIVKIAGNHGGAQALQAVLELEPTLRERGLTPQQVVAIANNGGGKQALETVQRLLPVLCQAHGLTPDQVVAIASHDGGKQALETVQRLLPVLCQDHGLTPAQVVAIASHDGGKQALETVQALLPVLCQDHGLTPDQVVAIANHDGGKQALETVQRLLPVLCQAHGLTPEQVVAIASGGGKQALETVQRLLPVLCQAHGFSQADIVKIAGNHGGAQALQAVLELEPTLRERGLTPDQVVAIASGGGKQALETVQRLLPVLCQDHGLTPAQVVAIASNHGGKQALETVQALLPVLCQAHGLTPDQVVAIANHDGGKQALETVQRLLPVLCQAHGLTPDQVVAIANGGGKQALETVQRLLPVLCQAHGLTPEQVVAIASNHGGKQALETVQRLLPVLCQAHGLTPQQVVAIANNIGGKQALETVQRLLPVLCQAHGYSRADIVKIAGHDGGAQALKAVVMHGPTLCERGLTPDQVVAIANHDGGKQALETVQRLLPVLCQDHGLTPQQVVAIASNGGGRPALESIVAQLSRPDPALAALTNDHLVALACLGGRPALDAVKKGLPHAPALIKRTNRRIPERTSHRVAKRTADGSEFEPKKKRKV

SEQ ID NO: 474 - protein, 1234 aa, synthetic construct
MARTKQTARKSTGGKAPRKQLATKAARKSAPGGASSGAGSSSGGSAAGSGSGGASSGAASSSARTLVTFKDVFVDFTREEWKLLDTAQQIVYRNVMLENYKNLVSLGYQLTKPDVILRLEKGEEPSGSETPGTSESATPESSPVEIYKTVSAWKRQPIRVLSLFGNIDKELKSLGFLESGSHSEGGTLKYVEDVTNVVRRDVEKWGPFDLLYGSTQPLGGSCDRCPGWYMFQFHRILQYARPRQESQPFFWIFMDNLLLTEDDQMTTVRFLQTEAVTLRDVRSRVLQNAVRVWSNIPGLKSKHEALSPKEEESLQGHVRTRSKLAAPKVDPLVKNCLLPLREYFKYFSQSSLPLGGPSSGAPPPSGGSPAGSPTSTEEGTSESATPESGPGTSTEPSEGSAPGSPAGSPTSTEEGTSTEPSEGSAPGTSTEPSEKRTADGSEFESPKKKRKVGIHRGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPDQVVAIASNGGGKQALETVQRLLPVLCQDHGFSQADIVKIAGNHGGAQALQAVLELEPTLRERGLTPQQVVAIANNHGGKQALETVQRLLPVLCQAHGLTPDQVVAIASNGGGKQALETVQRLLPVLCQDHGLTPAQVVAIASHDGGKQALETVQALLPVLCQDHGLTPDQVVAIANHDGGKQALETVQRLLPVLCQAHGLTPEQVVAIASHDGGKQALETVQRLLPVLCQAHGFSQADIVKIAGGGGAQALQAVLELEPTLRERGLTPDQVVAIASNHGGKQALETVQRLLPVLCQDHGLTPAQVVAIASGGGKQALETVQALLPVLCQAHGLTPDQVVAIANNHGGKQALETVQRLLPVLCQAHGLTPDQVVAIANHDGGKQALETVQRLLPVLCQAHGLTPEQVVAIASGGGKQALETVQRLLPVLCQAHGLTPQQVVAIANNHGGKQALETVQRLLPVLCQAHGYSRADIVKIAGNIGGAQALKAVVMHGPTLCERGLTPDQVVAIANHDGGKQALETVQRLLPVLCQDHGLTPQQVVAIASHDGGRPALESIVAQLSRPDPALAALTNDHLVALACLGGRPALDAVKKGLPHAPALIKRTNRRIPERTSHRVAKRTADGSEFEPKKKRKV

SEQ ID NO: 475 - protein, 1232 aa, synthetic construct
MARTKQTARKSTGGKAPRKQLATKAARKSAPGGASSGAGSSSGGSAAGSGSGGASSGAASSSARTLVTFKDVFVDFTREEWKLLDTAQQIVYRNVMLENYKNLVSLGYQLTKPDVILRLEKGEEPSGSETPGTSESATPESSPVEIYKTVSAWKRQPIRVLSLFGNIDKELKSLGFLESGSHSEGGTLKYVEDVTNVVRRDVEKWGPFDLLYGSTQPLGGSCDRCPGWYMFQFHRILQYARPRQESQPFFWIFMDNLLLTEDDQMTTVRFLQTEAVTLRDVRSRVLQNAVRVWSNIPGLKSKHEALSPKEEESLQGHVRTRSKLAAPKVDPLVKNCLLPLREYFKYFSQSSLPLGGPSSGAPPPSGGSPAGSPTSTEEGTSESATPESGPGTSTEPSEGSAPGSPAGSPTSTEEGTSTEPSEGSAPGTSTEPSEKRTADGSEFESPKKKRKVGIHRGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPDQVVAIASGGGKQALETVQRLLPVLCQDHGFSQADIVKIAGNHGGAQALQAVLELEPTLRERGLTPQQVVAIANGGGKQALETVQRLLPVLCQAHGLTPDQVVAIASNHGGKQALETVQRLLPVLCQDHGLTPAQVVAIASNHGGKQALETVQALLPVLCQDHGLTPDQVVAIANGGGKQALETVQRLLPVLCQAHGLTPEQVVAIASNHGGKQALETVQRLLPVLCQAHGFSQADIVKIAGHDGGAQALQAVLELEPTLRERGLTPDQVVAIASGGGKQALETVQRLLPVLCQDHGLTPAQVVAIASNHGGKQALETVQALLPVLCQAHGLTPDQVVAIANGGGKQALETVQRLLPVLCQAHGLTPDQVVAIANNHGGKQALETVQRLLPVLCQAHGLTPEQVVAIASNHGGKQALETVQRLLPVLCQAHGLTPQQVVAIANHDGGKQALETVQRLLPVLCQAHGYSRADIVKIAGNGGGAQALKAVVMHGPTLCERGLTPDQVVAIANNHGGKQALETVQRLLPVLCQDHGLTPQQVVAIASNGGGRPALESIVAQLSRPDPALAALTNDHLVALACLGGRPALDAVKKGLPHAPALIKRTNRRIPERTSHRVAKRTADGSEFEPKKKRKV

SEQ ID NO: 476 - protein, 1234 aa, synthetic construct
MARTKQTARKSTGGKAPRKQLATKAARKSAPGGASSGAGSSSGGSAAGSGSGGASSGAASSSARTLVTFKDVFVDFTREEWKLLDTAQQIVYRNVMLENYKNLVSLGYQLTKPDVILRLEKGEEPSGSETPGTSESATPESSPVEIYKTVSAWKRQPIRVLSLFGNIDKELKSLGFLESGSHSEGGTLKYVEDVTNVVRRDVEKWGPFDLLYGSTQPLGGSCDRCPGWYMFQFHRILQYARPRQESQPFFWIFMDNLLLTEDDQMTTVRFLQTEAVTLRDVRSRVLQNAVRVWSNIPGLKSKHEALSPKEEESLQGHVRTRSKLAAPKVDPLVKNCLLPLREYFKYFSQSSLPLGGPSSGAPPPSGGSPAGSPTSTEEGTSESATPESGPGTSTEPSEGSAPGSPAGSPTSTEEGTSTEPSEGSAPGTSTEPSEKRTADGSEFESPKKKRKVGIHRGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPDQVVAIASNHGGKQALETVQRLLPVLCQDHGFSQADIVKIAGNHGGAQALQAVLELEPTLRERGLTPQQVVAIANNHGGKQALETVQRLLPVLCQAHGLTPDQVVAIASNIGGKQALETVQRLLPVLCQDHGLTPAQVVAIASNHGGKQALETVQALLPVLCQDHGLTPDQVVAIANNHGGKQALETVQRLLPVLCQAHGLTPEQVVAIASNIGGKQALETVQRLLPVLCQAHGFSQADIVKIAGNIGGAQALQAVLELEPTLRERGLTPDQVVAIASGGGKQALETVQRLLPVLCQDHGLTPAQVVAIASNHGGKQALETVQALLPVLCQAHGLTPDQVVAIANGGGKQALETVQRLLPVLCQAHGLTPDQVVAIANNHGGKQALETVQRLLPVLCQAHGLTPEQVVAIASNHGGKQALETVQRLLPVLCQAHGLTPQQVVAIANNHGGKQALETVQRLLPVLCQAHGYSRADIVKIAGGGGAQALKAVVMHGPTLCERGLTPDQVVAIANNHGGKQALETVQRLLPVLCQDHGLTPQQVVAIASNHGGRPALESIVAQLSRPDPALAALTNDHLVALACLGGRPALDAVKKGLPHAPALIKRTNRRIPERTSHRVAKRTADGSEFEPKKKRKV

SEQ ID NO: 477 - protein, 1235 aa, synthetic construct
MARTKQTARKSTGGKAPRKQLATKAARKSAPGGASSGAGSSSGGSAAGSGSGGASSGAASSSARTLVTFKDVFVDFTREEWKLLDTAQQIVYRNVMLENYKNLVSLGYQLTKPDVILRLEKGEEPSGSETPGTSESATPESSPVEIYKTVSAWKRQPIRVLSLFGNIDKELKSLGFLESGSHSEGGTLKYVEDVTNVVRRDVEKWGPFDLLYGSTQPLGGSCDRCPGWYMFQFHRILQYARPRQESQPFFWIFMDNLLLTEDDQMTTVRFLQTEAVTLRDVRSRVLQNAVRVWSNIPGLKSKHEALSPKEEESLQGHVRTRSKLAAPKVDPLVKNCLLPLREYFKYFSQSSLPLGGPSSGAPPPSGGSPAGSPTSTEEGTSESATPESGPGTSTEPSEGSAPGSPAGSPTSTEEGTSTEPSEGSAPGTSTEPSEKRTADGSEFESPKKKRKVGIHRGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPDQVVAIASHDGGKQALETVQRLLPVLCQDHGFSQADIVKIAGNIGGAQALQAVLELEPTLRERGLTPQQVVAIANNHGGKQALETVQRLLPVLCQAHGLTPDQVVAIASGGGKQALETVQRLLPVLCQDHGLTPAQVVAIASNHGGKQALETVQALLPVLCQDHGLTPDQVVAIANNIGGKQALETVQRLLPVLCQAHGLTPEQVVAIASHDGGKQALETVQRLLPVLCQAHGFSQADIVKIAGNGGGAQALQAVLELEPTLRERGLTPDQVVAIASNHGGKQALETVQRLLPVLCQDHGLTPAQVVAIASNHGGKQALETVQALLPVLCQAHGLTPDQVVAIANHDGGKQALETVQRLLPVLCQAHGLTPDQVVAIANNGGGKQALETVQRLLPVLCQAHGLTPEQVVAIASGGGKQALETVQRLLPVLCQAHGLTPQQVVAIANNHGGKQALETVQRLLPVLCQAHGYSRADIVKIAGNHGGAQALKAVVMHGPTLCERGLTPDQVVAIANNIGGKQALETVQRLLPVLCQDHGLTPQQVVAIASNHGGRPALESIVAQLSRPDPALAALTNDHLVALACLGGRPALDAVKKGLPHAPALIKRTNRRIPERTSHRVAKRTADGSEFEPKKKRKV

SEQ ID NO: 478 - protein, 1235 aa, synthetic construct
MARTKQTARKSTGGKAPRKQLATKAARKSAPGGASSGAGSSSGGSAAGSGSGGASSGAASSSARTLVTFKDVFVDFTREEWKLLDTAQQIVYRNVMLENYKNLVSLGYQLTKPDVILRLEKGEEPSGSETPGTSESATPESSPVEIYKTVSAWKRQPIRVLSLFGNIDKELKSLGFLESGSHSEGGTLKYVEDVTNVVRRDVEKWGPFDLLYGSTQPLGGSCDRCPGWYMFQFHRILQYARPRQESQPFFWIFMDNLLLTEDDQMTTVRFLQTEAVTLRDVRSRVLQNAVRVWSNIPGLKSKHEALSPKEEESLQGHVRTRSKLAAPKVDPLVKNCLLPLREYFKYFSQSSLPLGGPSSGAPPPSGGSPAGSPTSTEEGTSESATPESGPGTSTEPSEGSAPGSPAGSPTSTEEGTSTEPSEGSAPGTSTEPSEKRTADGSEFESPKKKRKVGIHRGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPDQVVAIASGGGKQALETVQRLLPVLCQDHGFSQADIVKIAGNHGGAQALQAVLELEPTLRERGLTPQQVVAIANNHGGKQALETVQRLLPVLCQAHGLTPDQVVAIASNGGGKQALETVQRLLPVLCQDHGLTPAQVVAIASHDGGKQALETVQALLPVLCQDHGLTPDQVVAIANNGGGKQALETVQRLLPVLCQAHGLTPEQVVAIASNHGGKQALETVQRLLPVLCQAHGFSQADIVKIAGHDGGAQALQAVLELEPTLRERGLTPDQVVAIASNGGGKQALETVQRLLPVLCQDHGLTPAQVVAIASNHGGKQALETVQALLPVLCQAHGLTPDQVVAIANNIGGKQALETVQRLLPVLCQAHGLTPDQVVAIANNGGGKQALETVQRLLPVLCQAHGLTPEQVVAIASHDGGKQALETVQRLLPVLCQAHGLTPQQVVAIANGGGKQALETVQRLLPVLCQAHGYSRADIVKIAGNHGGAQALKAVVMHGPTLCERGLTPDQVVAIANNIGGKQALETVQRLLPVLCQDHGLTPQQVVAIASHDGGRPALESIVAQLSRPDPALAALTNDHLVALACLGGRPALDAVKKGLPHAPALIKRTNRRIPERTSHRVAKRTADGSEFEPKKKRKV

SEQ ID NO: 479 - protein, 1234 aa, synthetic construct
MARTKQTARKSTGGKAPRKQLATKAARKSAPGGASSGAGSSSGGSAAGSGSGGASSGAASSSARTLVTFKDVFVDFTREEWKLLDTAQQIVYRNVMLENYKNLVSLGYQLTKPDVILRLEKGEEPSGSETPGTSESATPESSPVEIYKTVSAWKRQPIRVLSLFGNIDKELKSLGFLESGSHSEGGTLKYVEDVTNVVRRDVEKWGPFDLLYGSTQPLGGSCDRCPGWYMFQFHRILQYARPRQESQPFFWIFMDNLLLTEDDQMTTVRFLQTEAVTLRDVRSRVLQNAVRVWSNIPGLKSKHEALSPKEEESLQGHVRTRSKLAAPKVDPLVKNCLLPLREYFKYFSQSSLPLGGPSSGAPPPSGGSPAGSPTSTEEGTSESATPESGPGTSTEPSEGSAPGSPAGSPTSTEEGTSTEPSEGSAPGTSTEPSEKRTADGSEFESPKKKRKVGIHRGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPDQVVAIASHDGGKQALETVQRLLPVLCQDHGFSQADIVKIAGHDGGAQALQAVLELEPTLRERGLTPQQVVAIANGGGKQALETVQRLLPVLCQAHGLTPDQVVAIASNHGGKQALETVQRLLPVLCQDHGLTPAQVVAIASNHGGKQALETVQALLPVLCQDHGLTPDQVVAIANHDGGKQALETVQRLLPVLCQAHGLTPEQVVAIASNGGGKQALETVQRLLPVLCQAHGFSQADIVKIAGHDGGAQALQAVLELEPTLRERGLTPDQVVAIASHDGGKQALETVQRLLPVLCQDHGLTPAQVVAIASHDGGKQALETVQALLPVLCQAHGLTPDQVVAIANHDGGKQALETVQRLLPVLCQAHGLTPDQVVAIANGGGKQALETVQRLLPVLCQAHGLTPEQVVAIASNHGGKQALETVQRLLPVLCQAHGLTPQQVVAIANGGGKQALETVQRLLPVLCQAHGYSRADIVKIAGNHGGAQALKAVVMHGPTLCERGLTPDQVVAIANNGGGKQALETVQRLLPVLCQDHGLTPQQVVAIASNGGGRPALESIVAQLSRPDPALAALTNDHLVALACLGGRPALDAVKKGLPHAPALIKRTNRRIPERTSHRVAKRTADGSEFEPKKKRKV

SEQ ID NO: 480 - protein, 1234 aa, synthetic construct
MARTKQTARKSTGGKAPRKQLATKAARKSAPGGASSGAGSSSGGSAAGSGSGGASSGAASSSARTLVTFKDVFVDFTREEWKLLDTAQQIVYRNVMLENYKNLVSLGYQLTKPDVILRLEKGEEPSGSETPGTSESATPESSPVEIYKTVSAWKRQPIRVLSLFGNIDKELKSLGFLESGSHSEGGTLKYVEDVTNVVRRDVEKWGPFDLLYGSTQPLGGSCDRCPGWYMFQFHRILQYARPRQESQPFFWIFMDNLLLTEDDQMTTVRFLQTEAVTLRDVRSRVLQNAVRVWSNIPGLKSKHEALSPKEEESLQGHVRTRSKLAAPKVDPLVKNCLLPLREYFKYFSQSSLPLGGPSSGAPPPSGGSPAGSPTSTEEGTSESATPESGPGTSTEPSEGSAPGSPAGSPTSTEEGTSTEPSEGSAPGTSTEPSEKRTADGSEFESPKKKRKVGIHRGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPDQVVAIASNHGGKQALETVQRLLPVLCQDHGFSQADIVKIAGNHGGAQALQAVLELEPTLRERGLTPQQVVAIANNHGGKQALETVQRLLPVLCQAHGLTPDQVVAIASGGGKQALETVQRLLPVLCQDHGLTPAQVVAIASNHGGKQALETVQALLPVLCQDHGLTPDQVVAIANHDGGKQALETVQRLLPVLCQAHGLTPEQVVAIASNGGGKQALETVQRLLPVLCQAHGFSQADIVKIAGNHGGAQALQAVLELEPTLRERGLTPDQVVAIASGGGKQALETVQRLLPVLCQDHGLTPAQVVAIASNHGGKQALETVQALLPVLCQAHGLTPDQVVAIANNGGGKQALETVQRLLPVLCQAHGLTPDQVVAIANGGGKQALETVQRLLPVLCQAHGLTPEQVVAIASNHGGKQALETVQRLLPVLCQAHGLTPQQVVAIANHDGGKQALETVQRLLPVLCQAHGYSRADIVKIAGNIGGAQALKAVVMHGPTLCERGLTPDQVVAIANNGGGKQALETVQRLLPVLCQDHGLTPQQVVAIASHDGGRPALESIVAQLSRPDPALAALTNDHLVALACLGGRPALDAVKKGLPHAPALIKRTNRRIPERTSHRVAKRTADGSEFEPKKKRKV

SEQ ID NO: 481 - protein, 1234 aa, synthetic construct
MARTKQTARKSTGGKAPRKQLATKAARKSAPGGASSGAGSSSGGSAAGSGSGGASSGAASSSARTLVTFKDVFVDFTREEWKLLDTAQQIVYRNVMLENYKNLVSLGYQLTKPDVILRLEKGEEPSGSETPGTSESATPESSPVEIYKTVSAWKRQPIRVLSLFGNIDKELKSLGFLESGSHSEGGTLKYVEDVTNVVRRDVEKWGPFDLLYGSTQPLGGSCDRCPGWYMFQFHRILQYARPRQESQPFFWIFMDNLLLTEDDQMTTVRFLQTEAVTLRDVRSRVLQNAVRVWSNIPGLKSKHEALSPKEEESLQGHVRTRSKLAAPKVDPLVKNCLLPLREYFKYFSQSSLPLGGPSSGAPPPSGGSPAGSPTSTEEGTSESATPESGPGTSTEPSEGSAPGSPAGSPTSTEEGTSTEPSEGSAPGTSTEPSEKRTADGSEFESPKKKRKVGIHRGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPDQVVAIASNHGGKQALETVQRLLPVLCQDHGFSQADIVKIAGGGGAQALQAVLELEPTLRERGLTPQQVVAIANNHGGKQALETVQRLLPVLCQAHGLTPDQVVAIASNIGGKQALETVQRLLPVLCQDHGLTPAQVVAIASGGGKQALETVQALLPVLCQDHGLTPDQVVAIANNHGGKQALETVQRLLPVLCQAHGLTPEQVVAIASHDGGKQALETVQRLLPVLCQAHGFSQADIVKIAGNIGGAQALQAVLELEPTLRERGLTPDQVVAIASNHGGKQALETVQRLLPVLCQDHGLTPAQVVAIASGGGKQALETVQALLPVLCQAHGLTPDQVVAIANNHGGKQALETVQRLLPVLCQAHGLTPDQVVAIANHDGGKQALETVQRLLPVLCQAHGLTPEQVVAIASHDGGKQALETVQRLLPVLCQAHGLTPQQVVAIANHDGGKQALETVQRLLPVLCQAHGYSRADIVKIAGNIGGAQALKAVVMHGPTLCERGLTPDQVVAIANNHGGKQALETVQRLLPVLCQDHGLTPQQVVAIASNIGGRPALESIVAQLSRPDPALAALTNDHLVALACLGGRPALDAVKKGLPHAPALIKRTNRRIPERTSHRVAKRTADGSEFEPKKKRKV

SEQ ID NO: 482 - protein, 1234 aa, synthetic construct
MARTKQTARKSTGGKAPRKQLATKAARKSAPGGASSGAGSSSGGSAAGSGSGGASSGAASSSARTLVTFKDVFVDFTREEWKLLDTAQQIVYRNVMLENYKNLVSLGYQLTKPDVILRLEKGEEPSGSETPGTSESATPESSPVEIYKTVSAWKRQPIRVLSLFGNIDKELKSLGFLESGSHSEGGTLKYVEDVTNVVRRDVEKWGPFDLLYGSTQPLGGSCDRCPGWYMFQFHRILQYARPRQESQPFFWIFMDNLLLTEDDQMTTVRFLQTEAVTLRDVRSRVLQNAVRVWSNIPGLKSKHEALSPKEEESLQGHVRTRSKLAAPKVDPLVKNCLLPLREYFKYFSQSSLPLGGPSSGAPPPSGGSPAGSPTSTEEGTSESATPESGPGTSTEPSEGSAPGSPAGSPTSTEEGTSTEPSEGSAPGTSTEPSEKRTADGSEFESPKKKRKVGIHRGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPDQVVAIASHDGGKQALETVQRLLPVLCQDHGFSQADIVKIAGNIGGAQALQAVLELEPTLRERGLTPQQVVAIANGGGKQALETVQRLLPVLCQAHGLTPDQVVAIASNHGGKQALETVQRLLPVLCQDHGLTPAQVVAIASHDGGKQALETVQALLPVLCQDHGLTPDQVVAIANHDGGKQALETVQRLLPVLCQAHGLTPEQVVAIASHDGGKQALETVQRLLPVLCQAHGFSQADIVKIAGGGGAQALQAVLELEPTLRERGLTPDQVVAIASNHGGKQALETVQRLLPVLCQDHGLTPAQVVAIASHDGGKQALETVQALLPVLCQAHGLTPDQVVAIANHDGGKQALETVQRLLPVLCQAHGLTPDQVVAIANHDGGKQALETVQRLLPVLCQAHGLTPEQVVAIASHDGGKQALETVQRLLPVLCQAHGLTPQQVVAIANNGGGKQALETVQRLLPVLCQAHGYSRADIVKIAGGGGAQALKAVVMHGPTLCERGLTPDQVVAIANNHGGKQALETVQRLLPVLCQDHGLTPQQVVAIASHDGGRPALESIVAQLSRPDPALAALTNDHLVALACLGGRPALDAVKKGLPHAPALIKRTNRRIPERTSHRVAKRTADGSEFEPKKKRKV

SEQ ID NO: 483 - protein, 1235 aa, synthetic construct
MARTKQTARKSTGGKAPRKQLATKAARKSAPGGASSGAGSSSGGSAAGSGSGGASSGAASSSARTLVTFKDVFVDFTREEWKLLDTAQQIVYRNVMLENYKNLVSLGYQLTKPDVILRLEKGEEPSGSETPGTSESATPESSPVEIYKTVSAWKRQPIRVLSLFGNIDKELKSLGFLESGSHSEGGTLKYVEDVTNVVRRDVEKWGPFDLLYGSTQPLGGSCDRCPGWYMFQFHRILQYARPRQESQPFFWIFMDNLLLTEDDQMTTVRFLQTEAVTLRDVRSRVLQNAVRVWSNIPGLKSKHEALSPKEEESLQGHVRTRSKLAAPKVDPLVKNCLLPLREYFKYFSQSSLPLGGPSSGAPPPSGGSPAGSPTSTEEGTSESATPESGPGTSTEPSEGSAPGSPAGSPTSTEEGTSTEPSEGSAPGTSTEPSEKRTADGSEFESPKKKRKVGIHRGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPDQVVAIASHDGGKQALETVQRLLPVLCQDHGFSQADIVKIAGNGGGAQALQAVLELEPTLRERGLTPQQVVAIANHDGGKQALETVQRLLPVLCQAHGLTPDQVVAIASNGGGKQALETVQRLLPVLCQDHGLTPAQVVAIASGGGKQALETVQALLPVLCQDHGLTPDQVVAIANNHGGKQALETVQRLLPVLCQAHGLTPEQVVAIASGGGKQALETVQRLLPVLCQAHGFSQADIVKIAGNHGGAQALQAVLELEPTLRERGLTPDQVVAIASNHGGKQALETVQRLLPVLCQDHGLTPAQVVAIASNHGGKQALETVQALLPVLCQAHGLTPDQVVAIANNHGGKQALETVQRLLPVLCQAHGLTPDQVVAIANNHGGKQALETVQRLLPVLCQAHGLTPEQVVAIASNHGGKQALETVQRLLPVLCQAHGLTPQQVVAIANNHGGKQALETVQRLLPVLCQAHGYSRADIVKIAGNGGGAQALKAVVMHGPTLCERGLTPDQVVAIANNHGGKQALETVQRLLPVLCQDHGLTPQQVVAIASNHGGRPALESIVAQLSRPDPALAALTNDHLVALACLGGRPALDAVKKGLPHAPALIKRTNRRIPERTSHRVAKRTADGSEFEPKKKRKV

SEQ ID NO: 484 - protein, 1235 aa, synthetic construct
MARTKQTARKSTGGKAPRKQLATKAARKSAPGGASSGAGSSSGGSAAGSGSGGASSGAASSSARTLVTFKDVFVDFTREEWKLLDTAQQIVYRNVMLENYKNLVSLGYQLTKPDVILRLEKGEEPSGSETPGTSESATPESSPVEIYKTVSAWKRQPIRVLSLFGNIDKELKSLGFLESGSHSEGGTLKYVEDVTNVVRRDVEKWGPFDLLYGSTQPLGGSCDRCPGWYMFQFHRILQYARPRQESQPFFWIFMDNLLLTEDDQMTTVRFLQTEAVTLRDVRSRVLQNAVRVWSNIPGLKSKHEALSPKEEESLQGHVRTRSKLAAPKVDPLVKNCLLPLREYFKYFSQSSLPLGGPSSGAPPPSGGSPAGSPTSTEEGTSESATPESGPGTSTEPSEGSAPGSPAGSPTSTEEGTSTEPSEGSAPGTSTEPSEKRTADGSEFESPKKKRKVGIHRGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPDQVVAIASHDGGKQALETVQRLLPVLCQDHGFSQADIVKIAGGGGAQALQAVLELEPTLRERGLTPQQVVAIANNHGGKQALETVQRLLPVLCQAHGLTPDQVVAIASNHGGKQALETVQRLLPVLCQDHGLTPAQVVAIASNIGGKQALETVQALLPVLCQDHGLTPDQVVAIANNHGGKQALETVQRLLPVLCQAHGLTPEQVVAIASGGGKQALETVQRLLPVLCQAHGFSQADIVKIAGNHGGAQALQAVLELEPTLRERGLTPDQVVAIASNHGGKQALETVQRLLPVLCQDHGLTPAQVVAIASNGGGKQALETVQALLPVLCQAHGLTPDQVVAIANNHGGKQALETVQRLLPVLCQAHGLTPDQVVAIANNIGGKQALETVQRLLPVLCQAHGLTPEQVVAIASHDGGKQALETVQRLLPVLCQAHGLTPQQVVAIANNGGGKQALETVQRLLPVLCQAHGYSRADIVKIAGHDGGAQALKAVVMHGPTLCERGLTPDQVVAIANNIGGKQALETVQRLLPVLCQDHGLTPQQVVAIASNGGGRPALESIVAQLSRPDPALAALTNDHLVALACLGGRPALDAVKKGLPHAPALIKRTNRRIPERTSHRVAKRTADGSEFEPKKKRKV

SEQ ID NO: 485 - protein, 1234 aa, synthetic construct
MARTKQTARKSTGGKAPRKQLATKAARKSAPGGASSGAGSSSGGSAAGSGSGGASSGAASSSARTLVTFKDVFVDFTREEWKLLDTAQQIVYRNVMLENYKNLVSLGYQLTKPDVILRLEKGEEPSGSETPGTSESATPESSPVEIYKTVSAWKRQPIRVLSLFGNIDKELKSLGFLESGSHSEGGTLKYVEDVTNVVRRDVEKWGPFDLLYGSTQPLGGSCDRCPGWYMFQFHRILQYARPRQESQPFFWIFMDNLLLTEDDQMTTVRFLQTEAVTLRDVRSRVLQNAVRVWSNIPGLKSKHEALSPKEEESLQGHVRTRSKLAAPKVDPLVKNCLLPLREYFKYFSQSSLPLGGPSSGAPPPSGGSPAGSPTSTEEGTSESATPESGPGTSTEPSEGSAPGSPAGSPTSTEEGTSTEPSEGSAPGTSTEPSEKRTADGSEFESPKKKRKVGIHRGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPDQVVAIASHDGGKQALETVQRLLPVLCQDHGFSQADIVKIAGGGGAQALQAVLELEPTLRERGLTPQQVVAIANNHGGKQALETVQRLLPVLCQAHGLTPDQVVAIASNGGGKQALETVQRLLPVLCQDHGLTPAQVVAIASGGGKQALETVQALLPVLCQDHGLTPDQVVAIANNHGGKQALETVQRLLPVLCQAHGLTPEQVVAIASNGGGKQALETVQRLLPVLCQAHGFSQADIVKIAGHDGGAQALQAVLELEPTLRERGLTPDQVVAIASNIGGKQALETVQRLLPVLCQDHGLTPAQVVAIASNIGGKQALETVQALLPVLCQAHGLTPDQVVAIANNHGGKQALETVQRLLPVLCQAHGLTPDQVVAIANHDGGKQALETVQRLLPVLCQAHGLTPEQVVAIASNGGGKQALETVQRLLPVLCQAHGLTPQQVVAIANGGGKQALETVQRLLPVLCQAHGYSRADIVKIAGNHGGAQALKAVVMHGPTLCERGLTPDQVVAIANNHGGKQALETVQRLLPVLCQDHGLTPQQVVAIASHDGGRPALESIVAQLSRPDPALAALTNDHLVALACLGGRPALDAVKKGLPHAPALIKRTNRRIPERTSHRVAKRTADGSEFEPKKKRKV

SEQ ID NO: 486 - protein, 1164 aa, synthetic construct
MARTKQTARKSTGGKAPRKQLATKAARKSAPGGASSGAGSSSGGSAAGSGSGGASSGAASSSAGSAAGSGSSPVEIYKTVSAWKRQPIRVLSLFGNIDKELKSLGFLESGSHSEGGTLKYVEDVTNVVRRDVEKWGPFDLLYGSTQPLGGSCDRCPGWYMFQFHRILQYARPRQESQPFFWIFMDNLLLTEDDQMTTVRFLQTEAVTLRDVRSRVLQNAVRVWSNIPGLKSKHEALSPKEEESLQGHVRTRSKLAAPKVDPLVKNCLLPLREYFKYFSQSSLPLGGPSSGAPPPSGGSPAGSPTSTEEGTSESATPESGPGTSTEPSEGSAPGSPAGSPTSTEEGTSTEPSEGSAPGTSTEPSEKRTADGSEFESPKKKRKVGIHRGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPDQVVAIASNGGGKQALETVQRLLPVLCQDHGFSQADIVKIAGNHGGAQALQAVLELEPTLRERGLTPQQVVAIANNHGGKQALETVQRLLPVLCQAHGLTPDQVVAIASNGGGKQALETVQRLLPVLCQDHGLTPAQVVAIASHDGGKQALETVQALLPVLCQDHGLTPDQVVAIANHDGGKQALETVQRLLPVLCQAHGLTPEQVVAIASHDGGKQALETVQRLLPVLCQAHGFSQADIVKIAGGGGAQALQAVLELEPTLRERGLTPDQVVAIASNHGGKQALETVQRLLPVLCQDHGLTPAQVVAIASGGGKQALETVQALLPVLCQAHGLTPDQVVAIANNHGGKQALETVQRLLPVLCQAHGLTPDQVVAIANHDGGKQALETVQRLLPVLCQAHGLTPEQVVAIASGGGKQALETVQRLLPVLCQAHGLTPQQVVAIANNHGGKQALETVQRLLPVLCQAHGYSRADIVKIAGNIGGAQALKAVVMHGPTLCERGLTPDQVVAIANHDGGKQALETVQRLLPVLCQDHGLTPQQVVAIASHDGGRPALESIVAQLSRPDPALAALTNDHLVALACLGGRPALDAVKKGLPHAPALIKRTNRRIPERTSHRVAKRTADGSEFEPKKKRKV

SEQ ID NO: 487 - protein, 1164 aa, synthetic construct
MARTKQTARKSTGGKAPRKQLATKAARKSAPGGASSGAGSSSGGSAAGSGSGGASSGAASSSAGSAAGSGSSPVEIYKTVSAWKRQPIRVLSLFGNIDKELKSLGFLESGSHSEGGTLKYVEDVTNVVRRDVEKWGPFDLLYGSTQPLGGSCDRCPGWYMFQFHRILQYARPRQESQPFFWIFMDNLLLTEDDQMTTVRFLQTEAVTLRDVRSRVLQNAVRVWSNIPGLKSKHEALSPKEEESLQGHVRTRSKLAAPKVDPLVKNCLLPLREYFKYFSQSSLPLGGPSSGAPPPSGGSPAGSPTSTEEGTSESATPESGPGTSTEPSEGSAPGSPAGSPTSTEEGTSTEPSEGSAPGTSTEPSEKRTADGSEFESPKKKRKVGIHRGVPMVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPDQVVAIASHDGGKQALETVQRLLPVLCQDHGFSQADIVKIAGHDGGAQALQAVLELEPTLRERGLTPQQVVAIANGGGKQALETVQRLLPVLCQAHGLTPDQVVAIASNHGGKQALETVQRLLPVLCQDHGLTPAQVVAIASNHGGKQALETVQALLPVLCQDHGLTPDQVVAIANHDGGKQALETVQRLLPVLCQAHGLTPEQVVAIASNGGGKQALETVQRLLPVLCQAHGFSQADIVKIAGHDGGAQALQAVLELEPTLRERGLTPDQVVAIASHDGGKQALETVQRLLPVLCQDHGLTPAQVVAIASHDGGKQALETVQALLPVLCQAHGLTPDQVVAIANHDGGKQALETVQRLLPVLCQAHGLTPDQVVAIANGGGKQALETVQRLLPVLCQAHGLTPEQVVAIASNHGGKQALETVQRLLPVLCQAHGLTPQQVVAIANGGGKQALETVQRLLPVLCQAHGYSRADIVKIAGNHGGAQALKAVVMHGPTLCERGLTPDQVVAIANNGGGKQALETVQRLLPVLCQDHGLTPQQVVAIASNGGGRPALESIVAQLSRPDPALAALTNDHLVALACLGGRPALDAVKKGLPHAPALIKRTNRRIPERTSHRVAKRTADGSEFEPKKKRKV

SEQ ID NO: 488 - protein, 1438 aa, synthetic construct
MARTKQTARKSTGGKAPRKQLATKAARKSAPGGASSGAGSSSGGSAAGSGSGGASSGAASSSAGSAAGSGSSPVEIYKTVSAWKRQPIRVLSLFGNIDKELKSLGFLESGSHSEGGTLKYVEDVTNVVRRDVEKWGPFDLLYGSTQPLGGSCDRCPGWYMFQFHRILQYARPRQESQPFFWIFMDNLLLTEDDQMTTVRFLQTEAVTLRDVRSRVLQNAVRVWSNIPGLKSKHEALSPKEEESLQGHVRTRSKLAAPKVDPLVKNCLLPLREYFKYFSQSSLPLGGPSSGAPPPSGGSPAGSPTSTEEGTSESATPESGPGTSTEPSEGSAPGSPAGSPTSTEEGTSTEPSEGSAPGTSTEPSEPKKKRKVGIHGVPAAKRNYILGLAIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKGPKKKRKV

SEQ ID NO: 489 - protein, 1052 aa, synthetic construct
KRNYILGLAIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 490 - protein, 176 aa, synthetic construct
SRPGERPFQCRICMRNFSQRSSLVRHTRTHTGEKPFQCRICMRNFSDKSVLARHLRTHTGSQKPFQCRICMRNFSQRSSLVRHTRTHTGEKPFQCRICMRNFSQRNNLGRHLRTHTGSQKPFQCRICMRNFSTHAVLTRHTRTHTGEKPFQCRICMRNFSDRGNLTRHLRTHLRGS

SEQ ID NO: 491 - protein, 176 aa, synthetic construct
SRPGEAPFQCRICMRNFSQRSSLVRHTRTHTGEKPFQCRICMRNFSDKSVLARHLRTHTGSQKPFQCRICMRNFSQRSSLVRHTRTHTGEKPFQCRICMRNFSQRNNLGRHLRTHTGSQKPFQCRICMRNFSTHAVLTRHTRTHTGEKPFQCRICMRNFSDRGNLTRHLRTHLRGS

SEQ ID NO: 492 - protein, 176 aa, synthetic construct
SRPGERPFQCRICMANFSQRSSLVRHTRTHTGEKPFQCRICMRNFSDKSVLARHLRTHTGSQKPFQCRICMRNFSQRSSLVRHTRTHTGEKPFQCRICMRNFSQRNNLGRHLRTHTGSQKPFQCRICMRNFSTHAVLTRHTRTHTGEKPFQCRICMRNFSDRGNLTRHLRTHLRGS

SEQ ID NO: 493 - protein, 176 aa, synthetic construct
SRPGERPFQCRICMRNFSQRSSLVRHTRTHTGEKPFQCRICMRNFSDKSVLARHLRTHTGSQKPFQCRICMRNFSQRSSLVRHTRTHTGEKPFQCRICMANFSQRNNLGRHLRTHTGSQKPFQCRICMRNFSTHAVLTRHTRTHTGEKPFQCRICMRNFSDRGNLTRHLRTHLRGS

SEQ ID NO: 494 - protein, 176 aa, synthetic construct
SRPGERPFQCRICMANFSQRSSLVRHTRTHTGEKPFQCRICMRNFSDKSVLARHLRTHTGSQKPFQCRICMRNFSQRSSLVRHTRTHTGEKPFQCRICMANFSQRNNLGRHLRTHTGSQKPFQCRICMRNFSTHAVLTRHTRTHTGEKPFQCRICMRNFSDRGNLTRHLRTHLRGS

SEQ ID NO: 495 - protein, 176 aa, synthetic construct
SRPGERPFQCRICMANFSQRSSLVRHTRTHTGEKPFQCRICMANFSDKSVLARHLRTHTGSQKPFQCRICMRNFSQRSSLVRHTRTHTGEKPFQCRICMANFSQRNNLGRHLRTHTGSQKPFQCRICMANFSTHAVLTRHTRTHTGEKPFQCRICMRNFSDRGNLTRHLRTHLRGS

SEQ ID NO: 496 - protein, 176 aa, synthetic construct
SRPGERPFQCRICMANFSQRSSLVRHTRTHTGEKPFQCRICMANFSDKSVLARHLRTHTGSQKPFQCRICMANFSQRSSLVRHTRTHTGEKPFQCRICMANFSQRNNLGRHLRTHTGSQKPFQCRICMANFSTHAVLTRHTRTHTGEKPFQCRICMANFSDRGNLTRHLRTHLRGS

SEQ ID NO: 497 - protein, 176 aa, synthetic construct
SRPGEAPFQCRICMANFSQRSSLVRHTRTHTGEKPFQCRICMANFSDKSVLARHLRTHTGSQKPFQCRICMANFSQRSSLVRHTRTHTGEKPFQCRICMANFSQRNNLGRHLRTHTGSQKPFQCRICMANFSTHAVLTRHTRTHTGEKPFQCRICMANFSDRGNLTRHLRTHLRGS

SEQ ID NO: 498 - protein, 1332 aa, synthetic construct
MARTKQTARKSTGGKAPRKQLATKAARKSAPGGASSGAGSSSGGSAAGSGSGGASSGAASSSARTLVTFKDVFVDFTREEWKLLDTAQQIVYRNVMLENYKNLVSLGYQLTKPDVILRLEKGEEPSGSETPGTSESATPESSPVEIYKTVSAWKRQPIRVLSLFGNIDKELKSLGFLESGSHSEGGTLKYVEDVTNVVRRDVEKWGPFDLLYGSTQPLGGSCDRCPGWYMFQFHRILQYARPRQESQPFFWIFMDNLLLTEDDQMTTVRFLQTEAVTLRDVRSRVLQNAVRVWSNIPGLKSKHEALSPKEEESLQGHVRTRSKLAAPKVDPLVKNCLLPLREYFKYFSQSSLPLGGPSSGAPPPSGGSPAGSPTSTEEGTSESATPESGPGTSTEPSEGSAPGSPAGSPTSTEEGTSTEPSEGSAPGTSTEPSEKRTADGSEFESPKKKRKVCLSYETEILTVEYGLLPIGKIVEKRIECTVYSVDNNGNIYTQPVAQWHDRGEQEVFEYCLEDGSLIRATKDHKFMTVDGQMLPIDEIFERELDLMRVDNLPNGSGEGRGSLLTCGDVEENPGPIKIATRKYLGKQNVYDIGVGEPHNFALKNGFIASNCSRPGERPFQCRICMRNFSQRSSLVRHTRTHTGEKPFQCRICMRNFSDKSVLARHLRTHTGSQKPFQCRICMRNFSQRSSLVRHTRTHTGEKPFQCRICMRNFSQRNNLGRHLRTHTGSQKPFQCRICMRNFSTHAVLTRHTRTHTGEKPFQCRICMRNFSDRGNLTRHLRTHLRGSKRTADGSEFESPKKKRKVATNFSLLKQAGDVEENPGPIKIATRKYLGKQNVYDIGVGEPHNFALKNGFIASNCGVPAAMAERPFQCRICMRNFSTSGNLTRHIRTHTGEKPFACDICGRKFALSQDLNRHTKIHTHPRAPIPKPFQCRICMRNFSDRSALSRHIRTHTGEKPFACDICGRKFARNDDRKKHTKIHTGSQKPFQCRICMRNFSQSGNLARHIRTHTGEKPFACDICGRKFAQRIDLTRHTKIHLRQKDAARGSGGDAKSLTAWSKRTADGSEFEPKKKRKVATNFSLLKQAGDVEENPGPMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 499 - protein, 1332 aa, synthetic construct
MARTKQTARKSTGGKAPRKQLATKAARKSAPGGASSGAGSSSGGSAAGSGSGGASSGAASSSARTLVTFKDVFVDFTREEWKLLDTAQQIVYRNVMLENYKNLVSLGYQLTKPDVILRLEKGEEPSGSETPGTSESATPESSPVEIYKTVSAWKRQPIRVLSLFGNIDKELKSLGFLESGSHSEGGTLKYVEDVTNVVRRDVEKWGPFDLLYGSTQPLGGSCDRCPGWYMFQFHRILQYARPRQESQPFFWIFMDNLLLTEDDQMTTVRFLQTEAVTLRDVRSRVLQNAVRVWSNIPGLKSKHEALSPKEEESLQGHVRTRSKLAAPKVDPLVKNCLLPLREYFKYFSQSSLPLGGPSSGAPPPSGGSPAGSPTSTEEGTSESATPESGPGTSTEPSEGSAPGSPAGSPTSTEEGTSTEPSEGSAPGTSTEPSEKRTADGSEFESPKKKRKVCLSYETEILTVEYGLLPIGKIVEKRIECTVYSVDNNGNIYTQPVAQWHDRGEQEVFEYCLEDGSLIRATKDHKFMTVDGQMLPIDEIFERELDLMRVDNLPNGSGEGRGSLLTCGDVEENPGPIKIATRKYLGKQNVYDIGVGEPHNFALKNGFIASNCSRPGEAPFQCRICMRNFSQRSSLVRHTRTHTGEKPFQCRICMRNFSDKSVLARHLRTHTGSQKPFQCRICMRNFSQRSSLVRHTRTHTGEKPFQCRICMRNFSQRNNLGRHLRTHTGSQKPFQCRICMRNFSTHAVLTRHTRTHTGEKPFQCRICMRNFSDRGNLTRHLRTHLRGSKRTADGSEFESPKKKRKVATNFSLLKQAGDVEENPGPIKIATRKYLGKQNVYDIGVGEPHNFALKNGFIASNCGVPAAMAERPFQCRICMRNFSTSGNLTRHIRTHTGEKPFACDICGRKFALSQDLNRHTKIHTHPRAPIPKPFQCRICMRNFSDRSALSRHIRTHTGEKPFACDICGRKFARNDDRKKHTKIHTGSQKPFQCRICMRNFSQSGNLARHIRTHTGEKPFACDICGRKFAQRIDLTRHTKIHLRQKDAARGSGGDAKSLTAWSKRTADGSEFEPKKKRKVATNFSLLKQAGDVEENPGPMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 500 - protein, 1332 aa, synthetic construct
MARTKQTARKSTGGKAPRKQLATKAARKSAPGGASSGAGSSSGGSAAGSGSGGASSGAASSSARTLVTFKDVFVDFTREEWKLLDTAQQIVYRNVMLENYKNLVSLGYQLTKPDVILRLEKGEEPSGSETPGTSESATPESSPVEIYKTVSAWKRQPIRVLSLFGNIDKELKSLGFLESGSHSEGGTLKYVEDVTNVVRRDVEKWGPFDLLYGSTQPLGGSCDRCPGWYMFQFHRILQYARPRQESQPFFWIFMDNLLLTEDDQMTTVRFLQTEAVTLRDVRSRVLQNAVRVWSNIPGLKSKHEALSPKEEESLQGHVRTRSKLAAPKVDPLVKNCLLPLREYFKYFSQSSLPLGGPSSGAPPPSGGSPAGSPTSTEEGTSESATPESGPGTSTEPSEGSAPGSPAGSPTSTEEGTSTEPSEGSAPGTSTEPSEKRTADGSEFESPKKKRKVCLSYETEILTVEYGLLPIGKIVEKRIECTVYSVDNNGNIYTQPVAQWHDRGEQEVFEYCLEDGSLIRATKDHKFMTVDGQMLPIDEIFERELDLMRVDNLPNGSGEGRGSLLTCGDVEENPGPIKIATRKYLGKQNVYDIGVGEPHNFALKNGFIASNCSRPGERPFQCRICMANFSQRSSLVRHTRTHTGEKPFQCRICMRNFSDKSVLARHLRTHTGSQKPFQCRICMRNFSQRSSLVRHTRTHTGEKPFQCRICMRNFSQRNNLGRHLRTHTGSQKPFQCRICMRNFSTHAVLTRHTRTHTGEKPFQCRICMRNFSDRGNLTRHLRTHLRGSKRTADGSEFESPKKKRKVATNFSLLKQAGDVEENPGPIKIATRKYLGKQNVYDIGVGEPHNFALKNGFIASNCGVPAAMAERPFQCRICMRNFSTSGNLTRHIRTHTGEKPFACDICGRKFALSQDLNRHTKIHTHPRAPIPKPFQCRICMRNFSDRSALSRHIRTHTGEKPFACDICGRKFARNDDRKKHTKIHTGSQKPFQCRICMRNFSQSGNLARHIRTHTGEKPFACDICGRKFAQRIDLTRHTKIHLRQKDAARGSGGDAKSLTAWSKRTADGSEFEPKKKRKVATNFSLLKQAGDVEENPGPMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 501 - protein, 1332 aa, synthetic construct
MARTKQTARKSTGGKAPRKQLATKAARKSAPGGASSGAGSSSGGSAAGSGSGGASSGAASSSARTLVTFKDVFVDFTREEWKLLDTAQQIVYRNVMLENYKNLVSLGYQLTKPDVILRLEKGEEPSGSETPGTSESATPESSPVEIYKTVSAWKRQPIRVLSLFGNIDKELKSLGFLESGSHSEGGTLKYVEDVTNVVRRDVEKWGPFDLLYGSTQPLGGSCDRCPGWYMFQFHRILQYARPRQESQPFFWIFMDNLLLTEDDQMTTVRFLQTEAVTLRDVRSRVLQNAVRVWSNIPGLKSKHEALSPKEEESLQGHVRTRSKLAAPKVDPLVKNCLLPLREYFKYFSQSSLPLGGPSSGAPPPSGGSPAGSPTSTEEGTSESATPESGPGTSTEPSEGSAPGSPAGSPTSTEEGTSTEPSEGSAPGTSTEPSEKRTADGSEFESPKKKRKVCLSYETEILTVEYGLLPIGKIVEKRIECTVYSVDNNGNIYTQPVAQWHDRGEQEVFEYCLEDGSLIRATKDHKFMTVDGQMLPIDEIFERELDLMRVDNLPNGSGEGRGSLLTCGDVEENPGPIKIATRKYLGKQNVYDIGVGEPHNFALKNGFIASNCSRPGERPFQCRICMRNFSQRSSLVRHTRTHTGEKPFQCRICMRNFSDKSVLARHLRTHTGSQKPFQCRICMRNFSQRSSLVRHTRTHTGEKPFQCRICMANFSQRNNLGRHLRTHTGSQKPFQCRICMRNFSTHAVLTRHTRTHTGEKPFQCRICMRNFSDRGNLTRHLRTHLRGSKRTADGSEFESPKKKRKVATNFSLLKQAGDVEENPGPIKIATRKYLGKQNVYDIGVGEPHNFALKNGFIASNCGVPAAMAERPFQCRICMRNFSTSGNLTRHIRTHTGEKPFACDICGRKFALSQDLNRHTKIHTHPRAPIPKPFQCRICMRNFSDRSALSRHIRTHTGEKPFACDICGRKFARNDDRKKHTKIHTGSQKPFQCRICMRNFSQSGNLARHIRTHTGEKPFACDICGRKFAQRIDLTRHTKIHLRQKDAARGSGGDAKSLTAWSKRTADGSEFEPKKKRKVATNFSLLKQAGDVEENPGPMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 502 - protein, 1332 aa, synthetic construct
MARTKQTARKSTGGKAPRKQLATKAARKSAPGGASSGAGSSSGGSAAGSGSGGASSGAASSSARTLVTFKDVFVDFTREEWKLLDTAQQIVYRNVMLENYKNLVSLGYQLTKPDVILRLEKGEEPSGSETPGTSESATPESSPVEIYKTVSAWKRQPIRVLSLFGNIDKELKSLGFLESGSHSEGGTLKYVEDVTNVVRRDVEKWGPFDLLYGSTQPLGGSCDRCPGWYMFQFHRILQYARPRQESQPFFWIFMDNLLLTEDDQMTTVRFLQTEAVTLRDVRSRVLQNAVRVWSNIPGLKSKHEALSPKEEESLQGHVRTRSKLAAPKVDPLVKNCLLPLREYFKYFSQSSLPLGGPSSGAPPPSGGSPAGSPTSTEEGTSESATPESGPGTSTEPSEGSAPGSPAGSPTSTEEGTSTEPSEGSAPGTSTEPSEKRTADGSEFESPKKKRKVCLSYETEILTVEYGLLPIGKIVEKRIECTVYSVDNNGNIYTQPVAQWHDRGEQEVFEYCLEDGSLIRATKDHKFMTVDGQMLPIDEIFERELDLMRVDNLPNGSGEGRGSLLTCGDVEENPGPIKIATRKYLGKQNVYDIGVGEPHNFALKNGFIASNCSRPGERPFQCRICMANFSQRSSLVRHTRTHTGEKPFQCRICMRNFSDKSVLARHLRTHTGSQKPFQCRICMRNFSQRSSLVRHTRTHTGEKPFQCRICMANFSQRNNLGRHLRTHTGSQKPFQCRICMRNFSTHAVLTRHTRTHTGEKPFQCRICMRNFSDRGNLTRHLRTHLRGSKRTADGSEFESPKKKRKVATNFSLLKQAGDVEENPGPIKIATRKYLGKQNVYDIGVGEPHNFALKNGFIASNCGVPAAMAERPFQCRICMRNFSTSGNLTRHIRTHTGEKPFACDICGRKFALSQDLNRHTKIHTHPRAPIPKPFQCRICMRNFSDRSALSRHIRTHTGEKPFACDICGRKFARNDDRKKHTKIHTGSQKPFQCRICMRNFSQSGNLARHIRTHTGEKPFACDICGRKFAQRIDLTRHTKIHLRQKDAARGSGGDAKSLTAWSKRTADGSEFEPKKKRKVATNFSLLKQAGDVEENPGPMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 503 - protein, 1332 aa, synthetic construct
MARTKQTARKSTGGKAPRKQLATKAARKSAPGGASSGAGSSSGGSAAGSGSGGASSGAASSSARTLVTFKDVFVDFTREEWKLLDTAQQIVYRNVMLENYKNLVSLGYQLTKPDVILRLEKGEEPSGSETPGTSESATPESSPVEIYKTVSAWKRQPIRVLSLFGNIDKELKSLGFLESGSHSEGGTLKYVEDVTNVVRRDVEKWGPFDLLYGSTQPLGGSCDRCPGWYMFQFHRILQYARPRQESQPFFWIFMDNLLLTEDDQMTTVRFLQTEAVTLRDVRSRVLQNAVRVWSNIPGLKSKHEALSPKEEESLQGHVRTRSKLAAPKVDPLVKNCLLPLREYFKYFSQSSLPLGGPSSGAPPPSGGSPAGSPTSTEEGTSESATPESGPGTSTEPSEGSAPGSPAGSPTSTEEGTSTEPSEGSAPGTSTEPSEKRTADGSEFESPKKKRKVCLSYETEILTVEYGLLPIGKIVEKRIECTVYSVDNNGNIYTQPVAQWHDRGEQEVFEYCLEDGSLIRATKDHKFMTVDGQMLPIDEIFERELDLMRVDNLPNGSGEGRGSLLTCGDVEENPGPIKIATRKYLGKQNVYDIGVGEPHNFALKNGFIASNCSRPGERPFQCRICMANFSQRSSLVRHTRTHTGEKPFQCRICMANFSDKSVLARHLRTHTGSQKPFQCRICMRNFSQRSSLVRHTRTHTGEKPFQCRICMANFSQRNNLGRHLRTHTGSQKPFQCRICMANFSTHAVLTRHTRTHTGEKPFQCRICMRNFSDRGNLTRHLRTHLRGSKRTADGSEFESPKKKRKVATNFSLLKQAGDVEENPGPIKIATRKYLGKQNVYDIGVGEPHNFALKNGFIASNCGVPAAMAERPFQCRICMRNFSTSGNLTRHIRTHTGEKPFACDICGRKFALSQDLNRHTKIHTHPRAPIPKPFQCRICMRNFSDRSALSRHIRTHTGEKPFACDICGRKFARNDDRKKHTKIHTGSQKPFQCRICMRNFSQSGNLARHIRTHTGEKPFACDICGRKFAQRIDLTRHTKIHLRQKDAARGSGGDAKSLTAWSKRTADGSEFEPKKKRKVATNFSLLKQAGDVEENPGPMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 504 - protein, 1332 aa, synthetic construct
MARTKQTARKSTGGKAPRKQLATKAARKSAPGGASSGAGSSSGGSAAGSGSGGASSGAASSSARTLVTFKDVFVDFTREEWKLLDTAQQIVYRNVMLENYKNLVSLGYQLTKPDVILRLEKGEEPSGSETPGTSESATPESSPVEIYKTVSAWKRQPIRVLSLFGNIDKELKSLGFLESGSHSEGGTLKYVEDVTNVVRRDVEKWGPFDLLYGSTQPLGGSCDRCPGWYMFQFHRILQYARPRQESQPFFWIFMDNLLLTEDDQMTTVRFLQTEAVTLRDVRSRVLQNAVRVWSNIPGLKSKHEALSPKEEESLQGHVRTRSKLAAPKVDPLVKNCLLPLREYFKYFSQSSLPLGGPSSGAPPPSGGSPAGSPTSTEEGTSESATPESGPGTSTEPSEGSAPGSPAGSPTSTEEGTSTEPSEGSAPGTSTEPSEKRTADGSEFESPKKKRKVCLSYETEILTVEYGLLPIGKIVEKRIECTVYSVDNNGNIYTQPVAQWHDRGEQEVFEYCLEDGSLIRATKDHKFMTVDGQMLPIDEIFERELDLMRVDNLPNGSGEGRGSLLTCGDVEENPGPIKIATRKYLGKQNVYDIGVGEPHNFALKNGFIASNCSRPGERPFQCRICMANFSQRSSLVRHTRTHTGEKPFQCRICMANFSDKSVLARHLRTHTGSQKPFQCRICMANFSQRSSLVRHTRTHTGEKPFQCRICMANFSQRNNLGRHLRTHTGSQKPFQCRICMANFSTHAVLTRHTRTHTGEKPFQCRICMANFSDRGNLTRHLRTHLRGSKRTADGSEFESPKKKRKVATNFSLLKQAGDVEENPGPIKIATRKYLGKQNVYDIGVGEPHNFALKNGFIASNCGVPAAMAERPFQCRICMRNFSTSGNLTRHIRTHTGEKPFACDICGRKFALSQDLNRHTKIHTHPRAPIPKPFQCRICMRNFSDRSALSRHIRTHTGEKPFACDICGRKFARNDDRKKHTKIHTGSQKPFQCRICMRNFSQSGNLARHIRTHTGEKPFACDICGRKFAQRIDLTRHTKIHLRQKDAARGSGGDAKSLTAWSKRTADGSEFEPKKKRKVATNFSLLKQAGDVEENPGPMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 505 - protein, 1332 aa, synthetic construct
MARTKQTARKSTGGKAPRKQLATKAARKSAPGGASSGAGSSSGGSAAGSGSGGASSGAASSSARTLVTFKDVFVDFTREEWKLLDTAQQIVYRNVMLENYKNLVSLGYQLTKPDVILRLEKGEEPSGSETPGTSESATPESSPVEIYKTVSAWKRQPIRVLSLFGNIDKELKSLGFLESGSHSEGGTLKYVEDVTNVVRRDVEKWGPFDLLYGSTQPLGGSCDRCPGWYMFQFHRILQYARPRQESQPFFWIFMDNLLLTEDDQMTTVRFLQTEAVTLRDVRSRVLQNAVRVWSNIPGLKSKHEALSPKEEESLQGHVRTRSKLAAPKVDPLVKNCLLPLREYFKYFSQSSLPLGGPSSGAPPPSGGSPAGSPTSTEEGTSESATPESGPGTSTEPSEGSAPGSPAGSPTSTEEGTSTEPSEGSAPGTSTEPSEKRTADGSEFESPKKKRKVCLSYETEILTVEYGLLPIGKIVEKRIECTVYSVDNNGNIYTQPVAQWHDRGEQEVFEYCLEDGSLIRATKDHKFMTVDGQMLPIDEIFERELDLMRVDNLPNGSGEGRGSLLTCGDVEENPGPIKIATRKYLGKQNVYDIGVGEPHNFALKNGFIASNCSRPGEAPFQCRICMANFSQRSSLVRHTRTHTGEKPFQCRICMANFSDKSVLARHLRTHTGSQKPFQCRICMANFSQRSSLVRHTRTHTGEKPFQCRICMANFSQRNNLGRHLRTHTGSQKPFQCRICMANFSTHAVLTRHTRTHTGEKPFQCRICMANFSDRGNLTRHLRTHLRGSKRTADGSEFESPKKKRKVATNFSLLKQAGDVEENPGPIKIATRKYLGKQNVYDIGVGEPHNFALKNGFIASNCGVPAAMAERPFQCRICMRNFSTSGNLTRHIRTHTGEKPFACDICGRKFALSQDLNRHTKIHTHPRAPIPKPFQCRICMRNFSDRSALSRHIRTHTGEKPFACDICGRKFARNDDRKKHTKIHTGSQKPFQCRICMRNFSQSGNLARHIRTHTGEKPFACDICGRKFAQRIDLTRHTKIHLRQKDAARGSGGDAKSLTAWSKRTADGSEFEPKKKRKVATNFSLLKQAGDVEENPGPMVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 506 - protein, 40 aa, synthetic construct
GGASSGAGSSSGGSAAGSGSGGASSGAASSSAGSAAGSGS

SEQ ID NO: 507 - DNA, 26 bp, synthetic construct
  source 1..26: mol_type = other DNA
gagtggttaattttattattaggggt

SEQ ID NO: 508 - DNA, 28 bp, synthetic construct
  source 1..28: mol_type = other DNA
tttctaacaatttatttaatcctaacca

SEQ ID NO: 509 - DNA, 21 bp, synthetic construct
  source 1..21: mol_type = other DNA
ggaacccctagtgatggagtt

SEQ ID NO: 510 - DNA, 16 bp, synthetic construct
  source 1..16: mol_type = other DNA
cggcctcagtgagcga

---

What is claimed is:

1. A fusion protein comprising a H3K4me0, a DNMT3 methyltransferase-binding domain, and a DNA-binding domain.

2. The fusion protein of claim 1, wherein:
   a) the fusion protein lacks nuclease activity;
   b) the fusion protein lacks a DNA methyltransferase catalytic domain;
   c) the DNMT3 methyltransferase-binding domain binds a catalytic domain of DNMT3A,
   or any combination of the foregoing.

3. The fusion protein of claim 1, wherein the DNMT3 methyltransferase-binding domain comprises a DNA methyltransferase 3-like protein (Dnmt3L), or a C-terminal fragment of Dnmt3L.

4. The fusion protein of claim 1, wherein the DNA-binding domain comprises a DNA-binding domain of:
   a) a clustered regularly interspaced short palindromic repeats (CRISPR)-associated protein (Cas);
   b) a transcription activator-like effector nuclease (TALEN);
   c) a zinc finger nuclease (ZFN);
   d) a tetracycline-controlled repressor (tetR);
   e) a meganuclease;
   f) a homing (HO) endonuclease; or
   g) a eukaryotic programmable RNA-guided endonuclease.

5. The fusion protein of claim 1, wherein the DNA-binding domain comprises:
   a) *Streptococcus pyogenes* dCas9;
   b) *Staphylococcus aureus* dCas9;
   c) *S. aureus* dCas9;
   d) dCas12a; or
   e) dCas12f.

6. The fusion protein of claim 1, wherein the DNA-binding domain comprises a leucine zipper domain, a winged helix domain, a helix-turn-helix domain, a helix-loop-helix domain, a chromatin-associated high-mobility group (HMG)-box domain, a white-opaque regulator 3 (Wor3) domain, an oligonucleotide/oligosaccharide-binding (OB)-fold domain, an immunoglobulin domain, or a B3 DNA-binding domain.

7. The fusion protein of claim 1, comprising, from N-terminus to C-terminus:
a) the H3K4me0, the DNMT3 methyltransferase-binding domain, and the DNA-binding domain; or
b) the H3K4me0, the DNA-binding domain, and the DNMT3 methyltransferase-binding domain.

8. The fusion protein of claim 1, further comprising a Krüppel-associated box (KRAB) domain.

9. The fusion protein of claim 8, wherein the KRAB domain is a KOX1 KRAB domain or a ZIM3 KRAB domain.

10. The fusion protein of claim 9, comprising, from N-terminus to C-terminus:
a) the H3K4me0, the DNMT3 methyltransferase-binding domain, the DNA-binding domain, and the KRAB domain;
b) the H3K4me0, the KRAB domain, the DNMT3 methyltransferase-binding domain, and the DNA-binding domain;
c) the H3K4me0, the DNA-binding domain, and the DNMT3 methyltransferase-binding domain, and the KRAB domain;
d) the H3K4me0, the KRAB domain, the DNA-binding domain, and the DNMT3 methyltransferase-binding domain; or
e) the H3K4me0, the DNA-binding domain, the KRAB domain, and the DNMT3 methyltransferase-binding domain.

11. The fusion protein of claim 1, wherein:
a) the H3K4me0 has at least 80% sequence identity to at least one sequence set forth in SEQ ID NO:87, SEQ ID NO:81, and SEQ ID NOs:393-396;
b) the DNMT3 methyltransferase-binding domain has at least 80% sequence identity to at least one sequence set forth in SEQ ID NOs:31-50 and 71-75;
c) the DNA-binding domain has at least 80% sequence identity to at least one sequence set forth in SEQ ID NO:1, SEQ ID NO:489, SEQ ID NOs:3-15, and SEQ ID NOs:454-469;
or any combination of the foregoing.

12. The fusion protein of claim 1, wherein:
a) the H3K4me0 has 100% sequence identity to a sequence set forth in SEQ ID NO:87, SEQ ID NO:81, and SEQ ID NOs:393-396;
b) the DNMT3 methyltransferase-binding domain has 100% sequence identity to a sequence set forth in SEQ ID NOs:31-50 and 71-75;
c) the DNA-binding domain has 100% sequence identity to a sequence set forth in SEQ ID NO:1, SEQ ID NO:489, SEQ ID NOs:3-15, and SEQ ID NOs:454-469;
or any combination of the foregoing.

13. The fusion protein of claim 1, wherein:
a) the H3K4me0 has at least 80% sequence identity to SEQ ID NO:87, SEQ ID NO:81, or both;
b) the DNMT3 methyltransferase-binding domain has at least 80% sequence identity to SEQ ID NO:31, SEQ ID NO:32, or both;
c) the DNA-binding domain has at least 80% sequence identity to at least one sequence set forth in SEQ ID NO:1, SEQ ID NO:489, SEQ ID NOs:3-9, and SEQ ID NOs:454-461,
or any combination of the foregoing.

14. The fusion protein of claim 1, wherein:
a) the H3K4me0 has 100% sequence identity to SEQ ID NO:87 or SEQ ID NO:81;
b) the DNMT3 methyltransferase-binding domain has 100% sequence identity to SEQ ID NO:31 or SEQ ID NO:32;
c) the DNA-binding domain has 100% sequence identity to a sequence set forth in SEQ ID NO:1, SEQ ID NO:489, SEQ ID NOs:3-9, and SEQ ID NOs:454-461,
or any combination of the foregoing.

15. The fusion protein of claim 8, wherein the KRAB domain has at least 80% sequence identity to SEQ ID NO:155.

16. The fusion protein of claim 8, wherein the KRAB domain has 100% sequence identity to SEQ ID NO:155.

17. The fusion protein of claim 1, wherein the H3K4me0 is connected to the DNMT3 methyltransferase-binding domain with a linker of about 30-50 amino acids in length.

18. The fusion protein of claim 17, wherein the linker has 100% sequence identity to a sequence set forth in SEQ ID NOs:89-100, SEQ ID NOs:113-128, SEQ ID NO:145, SEQ ID NO:147, and SEQ ID NO:506.

19. The fusion protein of claim 17, wherein the linker has 100% sequence identity to SEQ ID NO:96 or SEQ ID NO:506.

20. The fusion protein of claim 8, wherein the H3K4me0 is connected to the KRAB domain with a linker of about 30-50 amino acids in length.

21. The fusion protein of claim 20, wherein the linker has 100% sequence identity to a sequence set forth in SEQ ID NOs:89-100, SEQ ID NOs:113-128, SEQ ID NO:145, SEQ ID NO:147, and SEQ ID NO:506.

22. The fusion protein of claim 20, wherein the linker has 100% sequence identity to SEQ ID NO:96 or SEQ ID NO:506.

23. A polynucleotide encoding the fusion protein of claim 1.

24. The polynucleotide of claim 23, wherein the polynucleotide is less than or equal to about 4.7 kb in length.

25. A gene delivery system comprising the polynucleotide of claim 23 and an adeno-associated viral vector.

26. The gene delivery system of claim 25, wherein the adeno-associated viral vector comprises an AAV3, AAV3b, AAV4, AAV5, AAV6, AAV7, AAV8, AAV9, AAVrh8, or AAV10 viral vector, or a variant thereof.

27. A gene delivery system comprising the polynucleotide of claim 23 and lipid nanoparticles.

28. A method of epigenetically modifying a genomic locus in a cell, comprising delivering to the cell the fusion protein of claim 1 or a polynucleotide encoding said fusion protein.

29. A method of treating a disease in a subject in need thereof, comprising administering to the subject the fusion protein of claim 1 or a polynucleotide encoding said fusion protein.

30. The method of claim 29, wherein the disease is a genetic disorder, an infectious disease, or a neurodegenerative disease.

* * * * *